United States Patent 11,549,145 (METHODS AND COMPOSITIONS FOR INHIBITING AND TREATING NEUROLOGICAL CONDITIONS) - sequence listing, part 61

SEQ ID NO: 1398 - DNA, 864315 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaaggaagtctcaaagagaaattacatttgaaatagtttattctaaaaagttttcaaatacttcagttacagaacttaaagtttataatgtatactaaatgttaatatttggttcgtactcaaaattttttttttaaggacaagagatgtaggttctgtgggtctaaaaataatacccatatgtgtcactatatattagttcttataataagcaattaaaaatgtataaccatatacataattactcatttttctttgatgatagtttaaataattaagaatgtgctaaatatattctgaagatgagcacaatttcaagtaataaattatgtagggctggttctaggtttaagtgaataaggagaagatagctgctgagtgctggaccagaatcccattttatttatttacttctacctgtattatgctctgggaatcagcatttcctacactataaaggaaatttccaaggcagagcagctaattttaccctggatattctcagcacctcatttctaatccttgtggcatacagttcttttattgacccctatattctcaaacacatctcccattgagctatgttcctttggggtgtacttctgtggcactctgcagtatcctcagtatctttctattatggccattggattccactggatcggatatcgggtcatttttgtagtgtttgtatgtgaatacatttatagtctcacatttggtgccattgtgttagacatagaacattctcgaaactatatttgaaagctgaatgtctggaagttgaacaataaacttacattataaggtcttgaaaaatatatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctgagctcaagcaatccacctgcctcagcctcccaaagttctggtattaaggtgtgagtcactgtgcctggccaggtcttaaaaatatttaatgtttaactgtctttcctattggtatggcgttcttgggctaggaaattaaggatatatgtgagaactatctcaggtgacaaatgactgagacgcaggaggtggtgcttagttctgggagcctgccagccagacatcctcacttcccacaagcccattggatttttttcccttactctcatccttgttactaccatgattgtaagatgaagccgtccctaaatgtgaaattttcttataggaatgagaggctgaatgaagtaggcaaaaggcatctttgttttcttttgccatgagaggacaaggtaagggaggcttctggcagtcactctacttacacttgaggacaagcctgaagctgtctaccttttacttcttttaactcacacacacctctggctgaattcttgccgacttcttgcatatcttctaccaggcttccacccggtaatagtaagtacagcaacaaaagtggaggaaggggagaggacttggtttgctctctgccctgaaagacaatcatcttttatattaggaagctccaggcccctggcaggtcaggatttccaaggatccttcttggtagatttagacaagctagattttggaaaggagagttgttaggtatagctgtggttcagctggcagttaaaacttttgttctgttagagcctgttactactggaaaccccgtttctactaaaaatacaaaaattagctggacgtggtggtgtgtgcctgtagtcccagctaatcaggaggctgaggcaggagaatcacttgaatctgggaggcggtggttgcagtgagccaagatcgcgccactgcactccagcctggcgacagagagagaaaaaaattacttatgctttctgtaatagatgttgttggttcagtacttttgttctttcagtagtaccacgagtttcttttggagaactcttttgccaatcaaagcaattgtgcaattttatttttttaattttaatttttttttgagacagagtcttactctgtcacccaaactggagtacagtggtgtgatctcggctcactgcaacatctgcctcccgggttcatgcgattctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaatcattgtgattaatatatcagcttagtttgacagatatttcttacctactaagtgctagacttggaccctgttttcaaagctctttaattctagctgggtaatatggcgtgtgttttttgtacacatcactctttattgtagttacttttgtactgagattttctgacaaaatctaatgtgctgtaatagttcatattgttaatacacatcttaagaagtttccatttgttattactacctaattctaataaaaattttattgcaaatattcattgaaaataaatataataattagttttaataatcaaatataacattttttccagatttccatgtcaaaaattatagatagtcctctgacaaaaattgggttaatattatttgtaacttggaaaacataatttttcagtaaaatggctaataattttttccctatctgacttgacctgctttttagatccttttatataagaagtagtaattcttttaaagtaaatatttctctaagagcctgctttgatagtccatacatacttttctcttctctgtagctagagcccctgtattttcagctatgccccagggttcaggactaatcctgtctatgaacctctgttggtataacttttgcacatttattcaatgttcatgtgattcaggagcatgtcctcaactttgcagtgtgttgccttgactgtgggcttagctttatgtattgaaagctcctacttgagctgactaagctttcatcttgaactgccatttcagttgctggatgcctttttttttttttttggctgggccacattccctgtttggtatcctagcccgtcagaggctaccgtcatgaatttccctttctagactcccataagttctgcaggcttttccttaattccaactctctggatgtggtactcccccataagtattaccagaccaatttggagacatctacttgcttactacccatttaattttttaaaaagttattattcattatattatatttgcctgctgggacacctactgtattgtttcttattggacaggtattagacctgaccacttgtctcaacttttgccttctatccaattcttgagatcaggatttggcaaataatctggctcactctttgcttttataaataaaattttattggaacacaatcatgctcactcctttaattattgtctgtgactacatttatcctacaatggtagggttgagtagttgccacaaacatattgtccacaaatttgaaaacatttatcttgccctttaccagaaaaaatttatccactgcataaagtatagcttatagccttgtacttttcatatggtgcctatttcaaacattgtactttttatctgtagagaacttaataaaaattaacatacttatcagatttttcatgtaattttaaaatttacttagtcaaatattgacagaagaagtcctggaatttaaactttattgctaatttttcttcattttttttaccagcattttgttaacgtgtctcatccacaatgtgtataggtttaactgattatattaattgatactttttacctatgtttaatcatgtacccatagtaccaaataccaggtgttgtccaatttattttctcaatactttaacaacatattcatttctctccatctttacttctgtcacactaaggcaattccataatttctttttccatccaatctattgtctattttgtaccagagtgagctttgaaaaactcagatgtgacaagtactaccagcccttcactgacttcatattaattgtaggataaaaacttaaatatggacctattccccagtaacctctgagcttctcaaaagaactatgcttctttctattttggagtttttttcaatatactccatatttctgcaatgcccatgtctctctatttaatctatttatatcaacttatcctttggagcccaccttaaatgtcagttcctcagaggagccttctttaagtagaaaataggttcctcaaaggcaggttgcatgtctgatttttttccctgctgtatcctcagtaactaatgtttactttgcagaatgtctaaagatgataagtgttgtatgtctgcttttttggtgaatgttcaaaatgtaaatagtttacaaattctactaattcttaaagatcacctcttattttgcctgcctgacaccatgtgttgtatagggtgtacaaactaggagattagtctctgttagtgagcaaagtaaatcacttacaattagattataggaattaattgttaagaaaatactgtgatttaagttatgtgtgaaaaattgttaaaatagaatttctgtatgcattcttatctgtgtctaaagtccttaagaccatccttactttagagagcatctagaaggacttacaggactcaagatgtagttgtacgcattactaagatttattatagcaatgtagtaaggatacatacttgggtcataagaggaaaagacataggttgagtctggagaaactcatgcatgtgattccttttgccccctgcctcctgtgaaggcacaggtatgcttgagtattgagtatactcctttttccaccaacaaaaaaatacactaatatgagcattgtttgaagcccattcagtgcccaaggttttcgttgggggctggtcatataaacaacctctgccttgcaagtaccaaaatcctggactcctagaaggaaagcggatgttcagtataagcttttctttttgtacagaaggctccacatagcaaaccactcttatcttagaggatgcggggaaggcaacttcccagacttcaccagtcaaggtccagctttccaagcaggctttccaaaggataacagtcttaggcttgctatattgtcttttttgtagtgttcttaaaataatgttttctaatgttatttgctttttattctagtcacagaggtacttctagctagatacattcctacattgaattaaattgaagttcttttagtaactaagaaaggggtatgagtagtaggtaggcagctactaatcctattatgctaagatttttttcaagtctcccttgggaaaaatttgaatgcctaatggggcacatcatgtgctacaattgcttttgttcactatgcttaagccacatcgatctcttttctggactttaaatacaacaaactttcttctgctgcagggcttttactgtgttattcacttttcctgttaggtcctttccatttttacttggcttataaccacttatttttcatgtctcaatttaaacttcatctgtgatacctcactaccctctcctcccatgtctcttaggttagctactcccagtattacctttcaattggattataattgtttactgtcttttcttttctagaggaacatattctcatcctagcatatcacatgaatgaatgaatgaatgaatgaatgaatgtaaaatttgggtggaggagaataggggagtgctagaggaaaaggagggaaagagattaaaatttgtatgacatttttgagaattatatatttaataattcaaatttaccctatctagtatcgtagccaccagtcacatgtagctattggatacttacatgtggctaatctgaattgagaaataagtgtaaaatacttactgggttcaaatacttttaaaaaaagaatgtaaagtatcttaatttcattacattttaaagtcattaaattgtttttggatatattgaataagtaaaaatgttaatattgatttcacctgtttttacttttttaatgtggttagtacaagattttaagtgacattttctaatagacagtacttgctcggaaagtgaggcgttgatgttttaccttagtgtgtggtcctacaaatttaaactttaggctattatcaagaagaaagtatctaaaaaatggcacattagcttttctttcctattgtactggtactagtttggggcaaaaaatgttgtgttttctgtttactcttttcattattttctgtttactcattttctgtttactcttttttcattatgtaagtaaatgatcaaaacaactgtaacagatcatgttcatgtttattccctctaataacatttataatagtaacaataattgctaacacataagtgattatcgtgtgcctggcactgttctaagggcttcatatatactaacacatttaatccttagaatagccctgttgttagataccattgtcattcctttttaacagatgaggaaactggggcgcagaggcagtaacacggtcaaggacacagcatgtttgagtcttaattccgctacctgataatgatagtacctaagaatgtgatttagagaattaaatgtgattcagagataatttactttcagagctctggctatatgacttactacatgtgacttttcacatagtaggcattcagtagatatttttttatttgaagaacactgagaaggtgtagtttctagtttatgctttccagctatattatatatgggtatttttgtgtatttcatttttggtaatatagttttgaatctcaaaatacaaaagagccgtgcgtatatgaacctcactaagcctcattataaaagacacatgagttgattccttttcttggcaaatccttccaggataaaaatagagctgtcactagaacaaaaaaagtatggaaaaagaaagctactagttttggtagtgactagggttgctttgggccatatctggttgtgccagtttgtttacttattatctatggtgacttttgcacaatgccagacttgagtacttgcaatagagatttcatggctcacaaagattttggccctttgcataaaacatttgccagtttctgactcatgaacatatcaatccaataaaagaatctagtgctggaccacaattaaattagaatctcctaggtttttcctgggctgctcccttaaaggtatgccagttagactgtcttgagattgtttttaggggaaagttggattttgattatatccaaatatggtcagagtggaatcctgagcgttcacaataagtgtatcccaggagttggcaaactgcagcttgcagtggcctggtcttgtattgcttacaagctaagaatgtttatttacattattagaggattgaaaaaagaggaggaagaagaagaaatgtgagtccatatgtagcacacaaagtctaaaatatttactatctggccctttatagaagaagtttgctgatccttggtctgcataatctgcactgttttttctgatcactaccctggtagtagccaaaaggagatgattcctttgtgatgacagatgcatttgttgacatttatttacagtcttagcactgtagactaagagagggtaagggaggtggagttttgtgtttcagttgatttataaggatgcagttttggtgtttgataatatttgatgcctctggattagatagcgaacatggaatatccatcaaatattgttgattgtttagctgttgtgtgctctttatgataaaagggcattgtcaaagtgccattgtcgtctggcacatggtcttgaaaactgaaaatatgtaatagcttaattgttatggccacagtggtgcagagggagtcagctgatcagaatgaatgggaggtgggtgggaatgaaataagtttgacaagagtagtctggaaagggatggagtggtaatgcctcatgcaatgtggcctttcttgtgatgtaaactggttgagttttggtggtcacaagtctgccatacagtggtaatctctgcatcagaaacagtcgtttgctttttgcccagtctatgatggtgaatatgttgctatgtgatacagtgatggatccaggcagcaattgtgacaatctgggtggtgcaggtttgatcaacaccttgattccagttgacctcatcctggaatgggcccctactgtggtcatcagcatgagtgacccagattatctgatcagcaatgattttttttctatagtttgtggcctctaagctttagtctttaaatctgccactctggttttccaagtggcagcgtaaacaggtaggccattggcaataacgatcagtcatttataacaagattcctcaagggaaataattgccagaattatgagaatggccttgaattttgcctactgagttatgcccactgaatagctggagctaagataaaacagcagcagtagcacgatgtataccattgggtttcagtttagttgaatgatcagtgaatcagactctgacattttggggaatttcatgtatcaaaggccccattaggcctgcagcttggcttcaagtggcaaaatgagggttaaagtttctccccaagggatgtgtcttgctatgttttgtgcttctataacagaatactacaggcaggataatttataatgaatggagatttattggatcatagttctggaggctgagaggtcaaatattgagatgctagcatctggcaagagccttcttgcagcctcctcacatggcacaaaggcaaagagagtgagtgagtgtgtgtgcacgcacactggtgaggggggctagtccgcttctgtgataacaagcctactctcgctataatggccttagttcatccatgagggcagagtcctcatgacctaaacatctcttaaaaatcccaccttccaatactgtcacaatggcaattaaatttcaatatgagttttggaggggacaaacattcaaaccatagcaggatggctgccactttttcatgtaaattcaaaagcttctgggtgccaagcctggtatgttcttgaatatgctgttttcatttgaccaggggcagctaccttactcagatcgagccagttgtaatgtctctctataagtttaaagtccataaaactggtgttgggcaaatcagaatttttttctgagagttttgaacttggaaccagagaaaaatgaggcttgtttttagtgacaaaaaagtgtaagaattggtagttgtcattgtttgtttcctgccatgatgagaaattaggtctacagagagcttaaagtcatctgaagtgacaaagagacagagttttggagtcatttgagactctgcttccaatagtttctgaggccttgtctttcccttatcttcactgggttttaccaataaatctcagcttttgtttaggctagtttaaattggctttctgtcactgattaaaatatgagtcctagcaaatacatattactctcttaggccaagtataattactgatggtttggcatgttaatttaagacatattaatttgtatttcacctagacccatttctgtttgtttgtgttgatgtcatggaagaaggaatgaaaactgtatgcacattaaactagatgtcatttccaaatttgtcagagttgttgttaaacatatgaagtgattttctctaagacacagaagaagcataaaacgttaaagtatactttggattaaaggtaataaaattagaaacaaagatttgattggcacaagcaagaaaagttatggagttttgggttatattggactcctagggaatatgaatctgtactttgaacatgacttagtacattggtgagagagctaacatgagtttggattgattctacatcagaagattcaccaggaagaactgagaaattcttcttagttttattcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttcgtttcagaattttgagcagtactgttgacattagaaaagatttaaaaatacctaacaggtttccaataagctatttgaagaggaagaaaaatgaaaaggagagaaatgttaatttttttaaaagagagaggctttaataactattttcttatgaatatatctttgaagtttattctgttacacagaaaaaaacatacatctaaatgactattgcttttttaaattcttttagctaatacttttcagtcgcggacacaccgtgttctcagagttttaaaacttctttgaaattttttttggtggccaattttgcagacacacaaggaaatcagtacctcagctatttattcaggagtggagtctcactctgtcacccaagctagagtacaggggcacaaccatcatagctgactgcaaacttgaactcctgggctcaggccatgctcctgccccagcctccccagcagctgatactacagctgtgcaccgccatgcccagccagtacctcagcttcatatacatactttcttttcttttagagactcagaggcagacatagaaacaaaatgcaattttcagtatttatccagaactataccttttgttagaatataaagatttgttgggatccagtgttacttatctactgctcttggctctgaatggtatttatttatttcaaatattcagactcacccctcaaataatcaagatttggcatcactgggacaattaagaaggatgacctgtaggccgtaaatgtagttgtgaatgaagagtaccaaatatgtttttatcagtgaaacactgatttgcttagcttatgaatacttagaaagacaacacattttagtctgtctaatccactagcatagtcaggaccttatggtttaaattctagccccatgtaacttccttcccagttcacccccaatattggcatttactaactggtagtatcttaggcatcttacttagattcttgaaatttacaatttcttcattgtaaaatatggttaatactacatttttcatgttttggttgtgataaattgcattaatcacagtgcctagcttggtaattggtggctactgttattaattatagtaatagcagtgatcgaatttctcttggattatttcatgattttatgaagggtaacagggttttctaattctgtaaaagaaaggaatgagttaaaactagaaggaatttaggtggattaaaagaaaaaccagtggattttaaaaactcgaacaggatgacaattattcatcgtatgacattgtattatttgttttctaacatgtttcctttgaatggaccgtatgggtgctttgttaacatatacctcaattttttcatgaggcaaatagttgttaatgtctaatacaaaagatggccattacatattataaagtgctcattattggtgtatatatcacctttgatataggagattattttattttatatttttgagatagagtcttactctgccgcccaggcttgagtgcagtggcatgatctcggcttacagcaacctccgcctcctgggttcaagtgattctcctgcctcagcctcctgagtagctgggattacaggtgcacaccaccatgcccagctaatttctatattttcagtagagacggggtttcaccaggctggggttgaactcctgacctcaagtgatccgcctgtcttggcctcccaaagtgctgggattacaggtgtgagccactgtacccagcctgatataggagacgattttaattagtatgtgggaaactttaattttagaaattatttattttactgtgtattaggaaaaatatatcccacatatttatacacatgatttcaaatattactgcttaagataatagtggaataaaagtttgcttataaaataaatttattataatctaaatatagtaaaatgagtaaatttaaagaaaaaatattaatagtattgttaataattattgagtggttattatatatgacacactcttgtacatacttgctatctattgtgtcatttagtcctcacagcagtttagagaggtaggtactatcattatttccattgtacaaatgagaatacgagacattagcgaacagagaagtaaacattcttgcccttagttatgaatctagtaagtggcagagctggaatatcaatccatgtactctgacagtgtctgacctcttagcccctatgtaataactgctgcttcttcaataaataatagtacaaaggatatatggatagggtagtaataaagttggtatacaaatacatgaagtttgtacaaactgctctagataatgaaatatttctaatctacaaagaacgtattttcatatgtgtataaaattgaatagagatgcattcaaagaatgtattaagattattctaaatattaaagggaacattattgtcattcacataatgaaataatactttatttaaaaaaacaaagtatggcgaagtatagtaagtttttttcaccacttctgcacctgcttctgtgaaaaggaaatattcatagtttataaggagtgaaagttggttttttaggtcattcacaactgcattccaaactgtttgatattttagcttcaggatttaacatcctaacaaaagtcatgtgacatcagcagtgaggtgcactgagagctctctcaggaatactcttaatagaaaggaagactttaggtctgtgaggttgtgcgggcttgaatgtgatttttatttgatatatgagctgtgacataactgttgcatgactgagatgtgcttgtaagtgctgtactatgcagatgggttttttttctgaaacaaagccaaaaataaaatcttgaatgtgttcatgtagtgggaaaagaatacttcatagaaacatatggaaacatttctaagtttttttcattatatgaaccttttactttctaagcatttttatgattgttcaagttaacatgtcatttacctcatattttccaagtttagtgagacatgggaaatcttatagtactctgatgtttggaaacaaccagataatttttaggaatgcacattttaggattaggtgaaatgattattagaaaattaggattgaataatgggtttatttttcattacattattaatcataagactatagctaattaattatattaatctgatgggatttgatgaggagatgtattgagtggtttctttttactcacttttaaattaaagcataggacaacattaaaggaaatcataaaagtaaaaagatacaagtatagcatgactgtttttaattctccacattcccttccaactcatgtcttcgtatatacatttttacatgttttttatttattatatgtttaccattttatgttatgctcttcttttcataacattatgttttaaaatttctctttggtggtcacgtaccactctgattgtctctctcattgtgggaagcatacaaatagaaaattttcttagattcaaagttcctcccaaggtctcattttatcttcctcttttctgtcacagagaaatgacttagaattatgtacatgttgcctctccagttagctttgatgctgagtccggtgtatattttgtagttctaacttcctgactctgtatttgacatacgtagaactctcttctgatttgtgggctcttctcctttgtctttttatcgttgatcttaagagaatacactgagtaatctctttctcctgtgttgcttcagctacaacccatacactgacaactgcttcatttaatgctgtagcccagaacatcttcctgaaactgtgacatttatttgaatatgccaaggtatctaaaactcactatattcagaaggaaatttaactcttcttttcttttcttttttttttgttttttgagatggagtttccctctgtcgcccaggctggagtgcagtggcgcgatctcagctcactgcaaggttcgcctcccgggttcacgccattctgcctcagcctcccgagtagctgggactagaggcacccaccaccacgcccggctaatgttttgtacttttagtagagatggggtttcaccgtgttagccaggatggtcttgatcttctgacctcgtgatccatccatcttggcctaactgttattttctaatcagagctaatggtatcacaattcaccccttgttttatgtaaaacacctaggaattctctttaacttaaattttctcttgtctgcatcttgtaagtcatcatgttctgttatttcttcctgctaaaccttcctgggctctactttgtgttaccatgcttttgtttctaatagtactgttgtaataatatctttccaagttctctcttgttgttttgcaattcattctctccaatgctgtctcagtgatctttctaaaatggaattctgattgtatccttcagtgttttctcatttgtcctcaagataaagttggaacttcttcccatgttagtacatgatcatttcatgaccttctcttagactcatcatgggaaactttcttcttcaagcctctttctttttactttttttttgagacagagtctcgctctgtcgcccaggctggagtgcagtggtgcgatctcagctcactgccagctcggcctcctgtgttcaagccattctcctgcctcagcctcccaagtagttgggactacaggtgcccgccaccatgcccggctaattttttgtatttttagtagagatggggtttcactgtgttagccaggaaggtctgaactacttatagtacatttctagccaaaacatagagtctctcatacctccttgctgttgcacatgctactgcatcttcctgcaaaatcttccctactctcataaccatttcttcttcttgtctgcttaacctgttttccattaagacatagctgaagcttcaaatccttcagactgctttaggtgtacttcttttaagttcccagagtgtgctttctaacatcttgtgccagttatatagtatatgccttacatacttttaaattgaattatttaatattattccactgacgtccttttttaaagaaattcattaacacttgaaatttaggtgatttattgtttcttagatacagcattttgtatcttcatgcatgttgatatttttaagttattttcctgcaaaaatttctgagagcacaaatattgggtcaaaattaaggacacttcttatgactcttgggcattgcctttcaggtaatgattcttaatatcaatcttgcctaaattacatgttataggtatagtaattttcagaaagcaagactcttggtgctgataacattttctctgtgtaaagaaattttttaaaacggatacataatattttacatatttatgtgatatatgtgatattttgttgcatgcgtaaaatgggtaataatcaggtcagaatatttggactatccataaccttgagtatttatcatttctatatgttgagaacatttcagtttctttctttgagttacttcaaaatatacaatacattgttgctattagcctccctactctgccatcaacattagaacttataccttctgtctaactgtatgtttgtactcattgacccatttctcttcatctcctgcaactcatccacacactcttcccagcctctggtatctatcattctactgtccaccttcatgataccaacttttttagctcttacatatgactgagaaaaagaaatattttatcattaagaaaaacctaatcttgacctaatattaatttttgtattctataaacatatatagacactattgtatgttaatctctgtacaaggcactgggaacacatatagtaaaagtcttcccctccctgtttctttccttggttattttcaaaatcgatttgtcaagaactctgaaaagtaacgtacataatataattcatacatgtttattgtactcattggagctgcctgttaaatatgaagaaatatcaatgttatatttaacctattaatgccataagtgtaaaatattttgttatttatagtttagggaatggcttaattacttgaaaaactgcctttttccatattaacatttttgcttttatcttttagattttaggaaggttgttttaattaggatcagattttaataatgagcagcaaaaatgaggtgcttttttttggaaaatataattagtagattgctgaatgaagttcagttttatttttttaacaagttgaatgatgattaggatttataatatggtttatttgtgtgtacttcttaaactgttctggtatgtttcatatatccatattaaaatacaagtagtagatggttatactatttctttgtacatgatatccacacaagaactctttgtactgttggtggtagtgttatacagttccacactatagtaagtgaatatattacctcaaccattaatcagcctaccattgccattgatgacccaatgcttaagttgtaacactatgctgctgacccagactctgggggcttatttttattttttgatgcattgctgtaggcaattttaagggtgtggaaccaagccattttctctcttggactcatttccacttttatttcctatgggaggcttagccttcctttcaaatatttgaatttctaaattgttcacctattctgtgattactaggtggaggagtaatgcccattttaacatactgaatttaaaaaaataaaatggcttaactgttctcagaaaataaaatggcttagcaattctcaaaattaaaattttgtaatttgtgaaatgcttttcttatagaaactttatttttttcatggattacttttattttgtgcttatgtgctaggaatgtttggcttggtttttgtccctggagagtgcagttgagaactgacaggttatatgaagttgaaaagaaatttaatgagttgtaaaaaccagtgtttcatttttccttggtaactaatatgtacttgtgaggaagtgtcctaaaaaatttaaaacgaataggccttcaggttgcctagtagctttcaattttaacattaatgaatgtatctcaaaaatgaaaataattttattcactaagaaaaatacagttattttatttttagaacgtgaatgtttggggcttgaatttgctggccatagttatccaatctcacagataaaatatatgtaatccatatagttttaaagtttttttttttaaactcacttttagtttgtttcctttctttatcaagaaattgatggaacattctacttgtaccaggtacattatgaggcactggggtttttaatgcgaagaaggtacagattgcgggagctcctttaatagggaaacagatatataagcacgtaattataatagtgtgtggtaagtactgctggacgttcaaaaggaagccgtgagaaaacagcagatgattatatttgaaggcttcagagaagagttgacattttcaggttagggtgtgtgtgtctgtgtgtgtgtgtgttaatgttagtggaggatgagtgtgatagtaagctcaatcatcacatgtttcacataaaatgaatcttctgtgcgctgttaaaaatggcattttatttgtaggtataaggagtgatttttgaaatggaaacaggcctggttaggttttccagaaagttgaccctgtgatggaattaggactgcaaactgcgtactagagagcaacacctgtgaaaaaaagggtcgggaacaagattggttggaaagagtcatcacattgtgaagctgattttgcagtctctgggcaacccagcagggacctctggaacaaaggttgttggaatattcctgcattagtggaaatggctaggtccttctaccaccattattcaggcattggctctgggcttctccatgaggagaatgcccttggctgaaaagctgaagtcaacttaataaaagctaacagctgaagactgtcagctaatcatgctccttgtagccaggcaatgtgttctttgttgaaggtgggggtggactttgggatgatactaattattcatggattgattgattgattgattgattgattcagtgagtgttaacagtttgacactatgtactagggttagggctgggtatgggtgataggaacaaaacagacatgtccttgttctcatgtagagaaaaggtatggaagaagaattttctaagcaaacagaaaatctgatataaaggaccgttacgggcaaaaccttggcttaaaggagagatagaaggccactttggctaaagaattctgagattaaaaaaagagattacagggaaacaaggtcagagagtttggcaggtgtcatactctaaagccttgcaagccacagtaagaattttggattttattcaaatagcattgggaggtcagtggagggtttcaaccaaaggagtgatacagtttgacttatggtttagaaagtttactcctgcttacctgtttccacattcaatagtcataatgcaaatatatcttgacttctgacttatacaatgttgtcacttggataattctttcacatcaccagtaattgtgtaacatctgcagaaaacacacattaattccattattagagtttatttttcccattttctgtgtttctgtagtaactcattaaccagttattttgcttttaagtaactattactgaattgtaagagccatattaattttaatttttagttgggtatatagaacttattatacatgttggggttttttttgcctattcatagctctgaaaaaagtaaataaaatgcttgtgtaggaattttatttaggcattttaaactcttcatgtgaatatcttgagtcgttaaagtttagtcccttactcgatccatatggctctctgttgtagtacaggacacaattgaaagctcctaggtttcctgcatatagcagggacctgcacagtgctgccttctagaactgcttttattttccttgaggtcagaagtcctcctcccataggaaattttagatctcattcccctccaaaatattgacttgcctaattgaaagttattttattcatgttgattcttatttaagatttataattgtttatgaaaaccaggttccagttctgagaaatgtcttctcagtaccaaagtttgaaccttggccacaccatttgttaaccatatgatttaggcaagtctctttacctctttaacaatcagtttcctcctctgtagaacggggaacaccggtagaacttgctttatagagtatagtgagaagtaagtgaaataatatagaatgtctggtataccatgactgttctataaatggaaattgttacagttttactgttacttttaatagattattactttattagggatagtagaaatgcagattcaagttgggcattcatctgaaatctactctggtttcagctttggccttggcctttgggaaattgaatagcagcattgtcacttcagtgtcatttgtggcattcctgaatttgtgtgtgaaaatgcttaccattatatctagcagcctaacatttctttgataaatgaggcatgtcatctggactttttgttaatgtttcagtgtttatttttaattacaggtaagcattctaaatgtaatagacaatgaacatatgcttatatgctttatgtgttaaagttctgtcaatgagttaaagtataagtgtttatcaccagagtaaaatactataattgtcaataattgtagaagctgttagtttcatgtatagaaatcgtgatttcacaagttcaaatattaggtcaggagattgacagttaacacaaatactaacctagtacttttttttttttcttgttagctggatatatttcttttgttgttgttgttgttttctttgtcacagaacactgtttgcagtagaggaaactggtgttgcagtctggtggtataacggcttgctcacataaaccagtacatgttcatcctttagtgcaagaagccctaatggcacataccctattaaaattcacggcatctccaatattctctctctctttttctttgtcatcttttcttttttaataaatgttttcaaggtttgtctaaaagaaggccatataggttcttggctagcagaagacaattcagaacagttgttgcacaattggactctcaccttctccaggctggttgttgatatcttattttttttccaactcatttttattaagaaaataaatgctccaactatcagttttacaaaatctctaagagaaacacaagagcaaggtgctgaggcaaaaaacacctgaggtagctttttctgtgtgtttttctcatttataaaatcggtaaatttaacgccctgggccaacaaccttgtataaattgctactttccttcacatttttttaaaaaagaaagaaataattttgctgaatattgatggcttatacaccaaaatgcaaaaagacaaaatacattctttcattgtggaattttttctttgtttggttgattgattggtttggtgggttcctgttttcttcttccaaaatgctaggacaagtaccattgactcttgttcttttgagtaaccaagcgtaagttgaggctgacgtgtgtgttttgcttttgttccttttgtgtgttgggatactcaaagcactgctttccttgggcgggggcgagggtggtgttgcgtagatatgggattgagatggagggatgagggaattcaaaagaatggagatggagaagtaggggaggggagggaggtgagagataaacagagagagagatagagaattatatagcagtatgcgaaaaaccagtttaaaacccatgaagcaaagagaaatggatgtataagctagacaggcatgaggagtgacagagtttccttttcaaggagatggtatccctcctgttgatatacacagatgatccataattgctgtgagtgtccttccgacaagatttccctctgggtgaattttgtgtaggtcacctcgaagctcctctctacaccgtgaacctcccaaagaaagactttaaagtctagaaaagcctgctttctctttaaaaagaaaaaaaaattaatagttgattaaaaattggaattagttgagttatttgatatgttatttctaaaacatattaccgctgcaggcaccctgcgtaacccgcaggccacgtatcttaccatcgtccccttctaatatgtgcacacatgtacagagatttgccacaaaaaagggtgtgcattttgcatggctttgaacacgttcacctatgttacttcaaccaaaaggtacagcattgtgggagttaaggagagatctgagtggatggtgaagtggattgctgaagctgcagaagtcctgggaggtaggaggcagggcccggaggttctggcaaacctggctgaccttcccccgcctccttggcccctgggattctcagggcctctgcagagtccctggccgcctccgcagacttctcattcctcagatggtctttggtttgcttccgatctggctggctgtgtttggtctcattttgtcaggtgttggaagggctccattcatctgttgttttgctgatgcctgtgggaggcctcacttgctgcgctgtgaggcgactccctgagggtatttctactcctgctgcttcacctcttgtacagtttccctgatactgcgctgtgcagtctggctagcaaagaagtgcccgataattctgatgatcacttcctcattttcatcgggcgtttggtcacgaggcacaatgatttctgcactagttaagttatgcagttcattcacagtcttgccacctttgccaatcacccggccagctgtggaagagagcactctgatatgggcttccagcttcacttcttctttggggttaaagaagttttcttcttttagtttcccgaagatccgtccctgggccttgatggaggctctggcgagtcttgccagctgtttgatgtgtgcccctttcttcccgatgatggtacccacagcctgggttgggatgaagagattcacaatctcctgctcttgataagaatgctgatgcgggaacgggccaaactggtgatgggggtacaggctggagaaagtatctggagtgggtattaacagccagcatatcattttcaaaggcctcacgcagcttcttcataatctccatctcagcactggcataggcctccactgtgcccttcacagtgatggttctttccgggttgcatatgctcaaatcctgcaaggatgagattgttatcttggtccctgtttcatgttcatttttcttcacatttctgccttcttttccaatcagtcttccaaacaagccattgtgggccacgattttcagaggaatctcttcggctagtttggtctcatctgcctctttctgcatgctttcaagaatcgtgtggcatgcttcagaagtcccctctggggtggcatggatggtgacaagcttctctgcagctccagagttctcttttctatggatgtctacccgggactgggtctgctcagtgatgttcactatggtcaagccctcctttcagaccatggcaccaacaaactgggttggatccgcagcgggaaatcagtctgtccggcctgagaagagcccccagggcgtgaccttgctcccggaagagtggtccccaccctgggctcgctgagggggtaaagggggagctcacctcttcatccaggatgtaggaaatcttgaaggaatagttctcaaactgatgcccgcttagctcctccatggctattttgcttcttcccttgttgcatatgtgacattgacaacagcagtttctgtgtctgtgttgacttgttccacattctccactatcccgtgttgagccaaaggtgcatccaacatcgcccactgcaggtgaggaggtatgtttcaaatctgaattttcctgttccttagctttttagagaccgagtaatcaacttccatgattttcccatgcaattccactttaccttggcctcgccgccgccccgccccgactctacacgccggtagggaaggggcttccgcggggttggggttcaggggccgcagggctggggttcgggggccgcgtggctgggagcagagcttgtgctggcgagagttgggtagtgcgctcgcgcagtccctagtacattattaactttatgaaagtctaatttttctaagtcaaaatgttcataaacatttaaataaaaataagacattaatggaggttgcattatatcctcattctttgtataatttataaaattgtttaatgtacaagcattaataaaacatttaaactatatacattttctatttaattgcaacaagtctcccaaagtaatgccctatttgggatttattcacatttataagattgaattaaaaggagaaatagaatgtttgaggaaggggaacaaaatgattaacagtatccaagaaaataatccttgactcaaatataataatgaaaaaatatgaagagtatgaaaagaagaaagtgttagagaaaaattagatcatctagaacacaccttactttctcagtaatcttaaaataatagaattttacaagagtgctttacaaccatttctgtgtagatttttaattaatgaattgttggtataggggaaagaaaatataattagttgctagaagtatcagcatcttcagtgcttccaaaaaagtcttgctcccacatctatttcagttggaattgaacaccttctttgttactacaaatatgtagagactatagtaataatgtagcagctgacagcaggtgagaaattgagtaccatgctatcgtattaaaaatcaactcttaacatgcttaatagaaatttatattgaaaatttattttaaataaaattctacatttatctttgtattccaaaaagtcattctgcaatgatatttggcttttgccgcagcttagtagtgtgctatattttaacaatatggaaagtagtaaaatctgtaccttttctgtgtgcctatcatatttattaatttacccaaattatacagaatgttgggtaagtttagaagaaagtatttttaacagcaaaatcctgtgttttcagcctacatttttttagaggctagtttctattttaattaataatttagtaggctgcatattatatataaaatttaaagaagtttttgtgtttcaacatagaggaattgctaattattttcttcttaagtgatgcgttacattaaatccactgaagtacttttcaacataatttattacacaagtactaccatgtaacacattttcagtgttatttcgttttccctcagttctttcatgagatagttattagaactacttactgtgaattagagataatagagacataaaacaaaaatttgcttttttcccttctacagtagaaaacaatggtaaccacttatttatttcattgtcaataaatgaaaatagaatagtgtctactggaaatgggtgtggagatcttaaagtttaaaaacagctgcgtagtatccgaataagtaatataggatgcattttaacaatgcaagaactggtttgatttaattaactgtggtttaatatgttgtgcatctcactcatggtataccatggtggcatttactggctgatgcttcaaagcactactgtttttcatccactatcatgggtcaattgtgttgtagaggcattatctaaggtctggaaaacagttctcaaggattttgctttaatgataggtgtaacatctagttcatttgttgatgtcaattttttttttttttttaaagacagaatcttgctctgctgcccgggctggagtgcagtggcgtgatctcagctcactgcaacctccgcttcccaggttcaagcaattctcctgactcagtctcctgagtagctgggattacaggtgtgtgccaccacgcctggctaatttttgtatttttagtagagacagggtttggccatattggccaggctggtcttgaactcctggcctcaagtgatccacctcctttggccccccaaagtgctaggattacaggcatgaactaccgtgcctgacctgttgattttaatttgatgtaatctctaagctctcttcttaatgactttaaagtttgaaactgtaatgtttttaccaagtagcttttaaatgatgtttcctgaaggacagaacagataaatttgaatgatgtatttctaaatacagacagcagtgatcttcatgtcctattacattcaccctataaaatcacctggatgtttttaaaaaggcaaatggagaatggagaaaaaagaggcattgctcacgtgatgtgtatagtgttctaagatttcttacatttgataatgctgtggtagttatcttagatataaagtagtttcaaaaattccagttctataaccacatctgatagggtttagctgtgtccccacccagatctcatcttgaattcccacgtgtcgtgggagggacctggtggaaagtctttcctgtgctgttctcatgatagtgaataagtcttacaagatctgatggttttaaaaagagatgttccccttcacaagctctctcattttttacctgccaccatccatgtaagatgtgacttgctcctccttgccttcccccatgattgtgaggcttccccagccacatggaactgtaagtccaattaaacctctttctgtaaattgctcagtctcgggtatgtctttatcagcagtgcgaaaatggactaatacaacaccttaacttttgaagtaaatgagatacctgacggtatttccccccaagtaatttgtgtttgcttttacagatactttttggattacttgattaaaaatgcaaaaactactataaaaatagaggattatatctctttaacattttatcactgttatctttcaatacattgacaatgcaagggtaatagttgagggtttttgtcaaaatgttggggtaagcaaccaggctaatgtaaagtggaggcaaggaaaatgtttcagtgaaaaggaaaacaggccatgtaaatatattgtcagtgaaaaaaagaaatgaataaataaacatttgataaaattaatgactgaaacagaaaaaatcacgaatgtttttggataataggctataccacagggatatagaattaattgaggaggtgatggtgagggataaaagactacacattgggtatagtggtgtatgctgcttgagtgatgagttccccaaaattagagaaatcaccactaaagatcttatccatgtgacccgaaccacctgttcccccaaaattattgaaataaagtaaaataaattttaaaaaattcatacaaaaaaaagaaagtgtttgttacctgacctgcattgtgcaggttggggttatttttttttttttttaattaagaatggcaaactccttctgaaactcttaatggccttcgtttctccaatttcaggtcttgctgctctcatccctacttcctataggctgtactaccagtaagcttctgtaataggcctctaggcagtcccagttccttccttaggtttgtgggtcgtgcttttccattgcctggagtacttcaatttactctaccctcatcctcttatctagtttacttttctttatccttgagtatactatagaccaggataggggtccctttataatttcaaagtgccctatacttccactgtcatagtacttatattaattgtacacttctctaaattagtgtaagagtttgtgggagtgtgtgtgtgtgtgtgtgtgtgtgtgtgaaaagacaatgtctttagttaataagcacaaaataaatatgttttgaatgagtagattctggttctagtatttactattttcagatttaggaaacaattaaatgtttaaatattacttcttagtccactctggggggattaggggaaaactaatggccatggggcaagcttaggtgaaggatgatgcttgagctcagctgtgtaggataagttaatctggagcgagttgctgataaaagtagaataaattttggtaagaacttttcctccagtgtattttggcatcactttgtagaataaaaaataagttaaaggatgttagtctataataaaatttatattgatacttcatgttaatactgacagttattggctagtttatcttattttaattaataataaagctaaaacaattgtttttaagcactaagagaaaaactgtgtcttgaaaaataaatagcattacgtgcaaaacatgtaatatgccaaccggtggcattttgcttccctataattattatcaagtgaatgattagattatcattctagtgatatatctaaaaataaatttatttcttatttatttatatgttatatggtaaatcttatatttagaatcttacaagggaagggaaaaacatctttttcccctctccaaaaatctactgagagaggaaggtatttatttggcttacctgaattacatgagacaatatctcaagatttcatctgagtaagaatcacttggggttgtgctaaaatgcaggttcttaggccagtcctgtttttgttggtgaggcccttacatttgacctttaatgagcatcccagtgttatcacattccaatgtgataacaaattggaaaataatgtgtatttcagcaattatgtaattcagatactaatgactgacccttattctcctggccattgagtgttgtggctgacacattctatataaatctgaggttcttctcaacaggttatatccaattctgtcataaatttagagtaatcttaagtacattgaattaagtgttacttattgaatgcatgacatttcacctagaattgacaaaatcagtcaaattactttattcttatcatctggataccctattttgccgagtaaactgtgttacatgtggttttgtttattacagtctgtgcaaaaagaaacatcaacaatattactgtcatttcactttggtgtttctggtattccactaatgcctcatttgtaatagttaggtatatctttatctttctagtaaactgtttggtttttaaagaatactcatcctcagcatttaacttttttctagatgacagtattttgggcctagggatactgatgtaaataattgacacagaattgcagataaagagaggttctgaggttaagaatcagttcagccagagtcaatctaaagcatctaaggctactaggaagctttaaggagccatgaatcatacttcagggacccaacagtaatgaaggtgtccaggttgaatccaagcattttctgtttatagttaaacagaacaataagatatgcaataatttaaagacattaaataattataaaggtttcactctttcctcctcatttactttatttcctactttagatggtattttggtggctcagttaaaataatacttaataaagttaggcttcatgtagaggggtaggatttgtatcagattaatgtaacttctaagtccctttatgcattccagataagaggaagtgtgaaccccctgatgccagagactgctgtttcttgattactaactctttgacctcaaaattcaatgaagtttagtatattaggcatagtgcattcaagctcattttctaagttatctttcatgttttgtcaactgccaggtggactctgggcattttttggggaaatgtggttaaagcagccataattatcaactgcttgaaatacttacccggtattttaaagaatattaataaggcctcatttaatttggttcgcagcttttagatgattgtacagtgatcatgatcatgtcttacatttttatatattccctagccatttaataatgtacttgagaactaaatattttaatagtatttccttacagtctgatacagcagcaatgttaggtagttaaatgttgtctactacataatattgagctcaattagcttgaaatggcaagttcatctaaagtacatatgaataaaagggattataagtatagtgaagtgttacatagaactggtaaatattttaagtatatgtactcattatgatttctaaatattatagccaaagcatgcagttacaacaatttccaaacattaactgtttgaaaactctttttacattttacgcttaataaactaatttgtacataagccacattattatttatatttaaaactaaaaaaaatcactttctccagctattctaacaaaaacttagtaagtaagcattgcttttaaaatgacacaatctactagttatttggtaagactagcataatcataaatttcccatccatgctttttccaaaaatactaacccatattgttctctctggacctgttgtagggatgactaatccaactgctgaggtctccctttatgtgtttgatggaacacttggcttgctggactacagctgtgtgtttatgtgcagtgcacacctgcaggggcctgacaaatagctgtagtatgcagaggatacaaaattaccctggcagtgctgcaaataaggaagtttctgttttgaagtccatatgtgtgtgtgcttgagatgccagctggtgtatttatgttgcatgcacagatgtaaaactgccaactgattttacaccaaataaagtctaatctttttatatgtactttgtgtcaaagttatgaagtggtatgtaagaatattctcatgacttaggtcttttaaaataaaagctgctattaaaaatatgaactcataagatgattaggaaagagaggaaagaggatagtgatagagatggtatttcttaactattatcctgtgtataataatgttgttatgactatatcattagataagtaaagttttgatttattataattatgaatgatatatattctcttttgtggctagagtcagtcaggtctttgtgaaatcccaatttatgaatactgaaatgtgaaagacaaatttatataattacttgacttgcaggctttggctattctatttttcaagtacatttgattttaacaagttgaaaggatggtgcacttttgccatttttagaatgtatttaaatttgttctgaaagaaatactagtgtttataaataccagggataatatttcccaagtctatggaaattttaaaaccaatataaaaatagtggaaaagccagttattcaaaagaacctttgaaagaagcaattttttttgtttcttttaatatgtcttctctaactaaatgaagaaatatattttattgactatatccatcccaaacaagaataatgatttgatcactagaaaattgatcttcaaattaatatttgcaaatgagatactttatgtctgttacttaagtgtaaacatagattagagtggaagcttttgtttaaaattagtgctggatatattcattttctctaagaaccatcattgcttatgaagcagtgatttttttccatatataattggtttctttttttttcttttggagttggagtctcgctattgtcagcccagactggagtgcaatggcgtggtctcggctcactgcaacctccgcctcccgggttcacgctattcgcctgcctcagcctcccaagtagctgagattacaggcgtccgccaccatggccagctaatttttgtacttttttagtagagacagggtttcaccatgttggccagggtggtctcaaactcctgacctcaggtaatccaccccaccttggcctcccaaagtgctgggattataggcatgagccaccgcgccaggcccatatataattggtttctaatattaatggatatgtttcagttgaatcattttcaaaaatattgacttttactgtatttgaaatatatgtataaattaagaatttttagacattgctcaacaagaactgtttatcagaatggttatatttgtttttgttttatttataacctctttattgttttgtctcattttatatgtataggtttataaatatttgcaaatggagcaaagtagttcaagtgcttatcaaaatcatgttaactttcttattagaaaattttaatggtaatgtaaaaatacgttgtcatatgtaatcttgtattcagttttgcatctgaaacacactgaatttgtctttcacctaagtatatctagatatattgattcttctgatattagtgtaagttatacttgagttctgactttttacttatagaattgccttatcatagttccttatttgactatattttactgacattttgtatgctttcctaattattatttttattgatagcgtcaaacttgtaaatagtttgtaatgcctttacaaatttaaatagtgttttaataggcatgattcctttttcttcaatggtaggcatgatgcctttttttgtcataaaagggatgtatatttgccattttatctagcaaaatttcacttgaacttttactgtaattaaatttcagcaaatgtgggaaaggcctgagcttttagcattgtcccttagccttaaagtctaaattttgactaaatcccggcatcttaattcatgaggaaagtttgatttggaataagttttatataatgagacaggaagatggactagaaaccacatctcccagtggttgacctgagggataagatgtttctgacaaaatatacaattacttgtatgacaaaaagtgcatgaagaaaccaagtacctcaatttccaaaatgaaaggcagtatggtatagctgaatgaactcttgatcaggagacagacaaaattctagccctgtaacacacagttgtatgttattaggctagtttcctggagctttagtttagtttaatttttctaccagagaaagggaatagtaattctgattaatattgatgtgagtattaataataagataagggacataaagctgttctgtggtcagggtgtggagcatgtagtaggtgttcaataatagttgacttttttttttaaagcagtagtagtaacagtttgaaaaagttcattacataggaaatatacatgtaaagttaactcagaaaaggatagacataagaaagcttcactgatgtcttacattttttcctgaaaatatattttaaagaaaggaccaaacctcaaatttttacagctaaaagaatcttttattacttatttgagagattatgttccatacattgcttggttatttagtgctagggccaactgcctttagtaggatatcacttcaaacgctgctgccgccactgcaggttgcaagcatatgattgaaggcttctagttctcagctcatgcccagatgtctttcaataactatagccagtaatttcttcaaattgctcactttatcagcagcacatgtcatcaatcctgaagtggttgctcaagtcaactgcagaatctttagcttatagacacagctgcaaacaggtgaacaggcagaaagtaatttgtgcagcttggtggctgtcagacgaaagacagacaatctgtgtttaaaacagattgcaggccctgtatgggccagacaaaagggatttctccaactgcaaataattctaaggttaacatattttcctttctgccattaggtgatttgttaaaattggaaacaatgaacattataaatctacacagaaactggagacaagatgaaagagaaaatcagatcactaaataggtttacatttgtctttccaaagaagtataactggcattcatataagctgttttcttacaaattaagccaagttataaaataattctttgaaactgcaagattataaatatttcaagttgcattaagaattactggtattaaaaaagcaatgaaccctgaacagtccagtttttataagcaggttttagagttaattgttaatttgtagatgttggaatttgcttctttataaatattatttagtgtttttcttgcagctttactaagtagattttaaaagtagcatatgctagatataacacacttttcagcacataaaatctaccatggttacagaacaaaaattcgtatggagaaaaatattctgaggacctatgcatttaaaaaagttatcctcacattttcgccttggagttattcggataagaatgtgaaagatatctgaatctatctgtaaaatagtcatattttagaagatagttctataataacactaagagtattcatcattttgtccataaatctcaaaatgataaacttatgagagtctgaatcagcaaagttatttttcatcagtattagtccatataagtgcctactcattaaactaaacaggaagaaggactatattacattagctaaatgagtacctcatgactgaagatagacacacacaaagtttagatatttaaaatatgtgtacatgtgtggtgcatggatgcatgtatgtgtagggaggaacacatgagaaataattgagtagtccttctttgttatctaccagagcttatggctatgacatagagaactgtaagtgaatgttactgatttattctcattgttggctctcttgtgctttctctcttgtttcacaatcaatttagtacggtaattgtttttaatagataatgatctatataacatagtgtttaagaacacagtcctcagtgtcaaattggatttaagttccagtttgataatactgtgtgattttgaacaagttacttaacctatcaaatccttagtttttcagtggtgatagtgactgtttattaacttacgttgttttgtgatattaaaaactcatatgaagtattgtgccttgtgccttgtacttatttaaagcttcaataaactttaggcattttctgctacaatccaaacatcctgaggaaagggaatgtttttgtcttgctcttagctgcttcctaagcatttattaccatgatttgaaccgctaagaactcagaagtaatctgaatgaacttgtcaataattctgtaatttttagagtccactgtgctgatttcttttagtcataatattcctttcttgtcaaatgccttgaccttaaatatgagaataattcttatttatttatcaagacagagtcttgctctgtcgcccaggctggagtacagtggtgcgatcttggctcactgtggcctctgcctcagcctcagtaatcccaagtagctgggattacaggcactcactactatgtctggctaatatttctattgttttagtacagatagggttttgccatgttggccaggctggcctcaaactcctggcctcatgtgatccacccgcctcagcctcccaaagttctgggattacaggtgtgagccgctgtgcccagccctgatttattttttgagtatagacaaagcggtatgattattttactgtctctcatttcagtttttctaacattaggaaattgttcttgattacagctgtttgtcaaaatatagctagctgtggtgccttatgctcacagaataatctggcattaaaaatcaattatattttactgttttttgttttgttttgttttttgagactgtgtctcgctttctcaaccaagccttttggtctccaaacttgcccaacatggttccactccattctttggccaaaaatcaatgggttcaagaacacaagttttaactgtagggcttaactttagatttctcatatcaaaatcgctttgcctctagagcagtagttagagcttccaatatatgctgaccttcaggccctacaccatacctgttgttttgaaatctctgaggatggggcctggatgttgatctttcaataaaatctttttgtgtcaatctaatgtggacccatggttgagaacaagtgctctaggacagcgactggcaaggtatgacccatggaccaaatccagcccatcagctgtttttgattcgaatgcagtaaccaccattatttggctggttagttattatcaatggctgttttgtgctacaacaccagagttaaataaatgcaacagagactgtcttgcaaagcctaaaatatttattatttaacccattataaaaaatgtttgctaacccattttagattatgagctctgatgcggtggctcacgcctgtaatcccagcactttgggaggccgaggtgggtggattatgaggtcaggagttcgagaccaccttggctaacatagtgaaactccatctctacaaaaaatacaaaaattagctgggcctggtagcatgtgcctgtaatcctagctactcaggaagctgaggcaggagaatcactcgaacctaggaggtggagatctcaccactgcactccagcctgggcgacagagcaagactctgtctcaaaaaaaaaaaaacaaaaaaagattatgagctctgattatcatcagttttgcacatatttcgtgtttgttggtactttaggcaatctattggtgaattagctagatatttttgattacctttctatttcttgcctaatagatagtgaactgtttgagggcaggcactatattttatagctctttaaaatcctcaacccctaatatagttaattttgcatagttgggtgtaagtaaatgttcgttaattgactctagttattggcctttggttattgcatgaaggtaccagtaagggacagtgtggagcttttgctttgtgcatgttcaattttttttttaactccttctattaaaatagacattattgtattttagaatattaccaagtcatcattttataattatagaaaatcccttaattttttccacttctggaattactgtcaaccttcattactcattgtttgtacttaatgtttagatctaagctacaaaacagcataccatattttcatcatcattactcttttaaaaatttgccttcattccagtttcagggagtttgggcaatgcctgtgatatttgtgtcttgaaaatatctcagtggtctgtcagatatgaggttgatccaattttaataatagttttttctacttcctgatctttaatgggttgaaattatcttggcttttactggtagtgtagtcataataattttttaattgtaggtgctcaagagagaaaacagacacaaagtgttctgtattggttctatattattcccctggaatgatgtgtttaactagttttcttttaaactatcaactacataaattttgttcaaggctggtgtcttagcatttgcgttacaactataagtagtacacatacatgtcttctatattcatttagaaagatcactatcttaaatttttttttcatttcacttgttaaatatagtgaatatgttatttggggcagggaaaaaaataaggcaatcaggcaggttgctgacggcagtccaaatggctgatcagagagtctttatatgcattggtaatgtgttgtgcaatataagctgaaatatattccacaagggaggaaaacggaataggttacatacactgttcctaagtgcaatgaatataaaactccattactcactttaggcaggtgctttttatatgaggctttaaagtaatataaaactgctggtgaaatgattggtttatacagacaccacttagcttccagtgctctaaccagataaagagactaaaactattaagatatttctttaatgattcagggattgatgtttaatattcttttggtataatagcctgtccctataacattgtatagttatgaaatttgtgtgtggctgggttacgaaagacttttttcagggaaagaggaaaaaatttcttgtttttctttgttaatgataaggaaatgaatctccccaaaatttctttcaatgtatacatatatagaaatatatatatctgcatttaaaaatatttttgaaggactttctaaatacatttcttggtagtttttttcagcttttctccaagaatgactgaacattttataggcattaagattgaataaattttgtaatgtacaataactctctttaggataactgtgaagttggttgatgaacattataaagcattaaaatatgtattagtccataaagatttgcagtgatcccacctagatatacaagcccctatatttctcgtttttgacacttttaactcttacagagaacaagtaacctgcttattgtttaaacactgaacattctcttatgagtgaatttttataaactaaaagggatgttaaaaggataacaaataggtgtttttcaaatttgtcttaggttttaaatatttgaaccagatggttttctttctaaatctgtcattgattgattgattgattttccctccctcccatccctcagtccctccatgtctccctcccttgagcttctcccccactcccaagcccacttccccttattaggtgacatttacatacaatcaactattttagagtgtatgattcagtggcatttagtgcattcacaatgttgtgcaactaccaggtctcagtttcaaaatctttatatcactccataaaaataccccatagcttctaagtaattgctcataattcctcctctccctcatcccctggtatcctctaatctaatctacttttgtctctgtggattttccttttctggacatctgatattaaaggaatcatatattaatattatgtgaccttttggttttcgccacagatctagccaagttgttgtgtgtatcaatagttcattcatttttttattgctcataatattccatgatatggatgtaccacagtttgttaaatcatttatctgttgaaggacatatttgttgtttccagtttttggctattacgataaagctgctataaacatttatatacaagtttttgtgtgaacatgcattttcgtttctctgggactaatgcctaagagtacagttactgggctatacggtagttgaatggtttttttttttttttttgagatggagtcttgctttgtgctcaaggctggagtacagtggcgcggtctcggctcactgcaagcccctccctggttcacgccgttctcctgcctcagcctccggagtagctgggactacagacacccgccaccacgcccggctaattttttgcacttttagtagagacggggtttcactgtgttagccaggatggtctcgatctcctgacctcatgatccacccaccttggcctcccaaagtgctgggattacagatgtgagccaccgcgcccggcctgaatgtttaagttttaaagaagctgccaaacttggggccaggcatgatggctcatgcctgtaatcccaacactttgggaagctaaggtgggatgattccttgagcccaggagtttgccgaggctgcagtgagctattaccttcgcactgcgttttagcctgggtgacagaggaagaccatgtctcttgcggttgggggtggtgggggagaaactgccaaacagttttcaggagcggctgtacattttacatttccaccagcaattgtatgacttactggtttcttcacatactcactggtatttaattttgctgctgtttttttattttagctgttgagatagatgtgtagtgatatctcattgtgattataatttgcatttctctgatagcaacacaaatgatgttgaatattttttaatatgtttatttgctatcagtgtatcccctcagtgaaatgcttgttcatgtttttagcccattttctaatagtattgtttgtgcttttattgttgagttttgaagcctctttatactattctagatactagtccttcagctatatggtttacaactatcttttctcagtctgtagcttttcttctcttagcagggtcttttgcaaagtaaaagtttataattttgatgaggccaatttttttcttcttatggattataattttgttgttaagattaagaactctctgcctaactcagataccaaagatttccccctatgcttttttctgacttaatttttttaaggtgttagacctagatttggcattaatgtttttgcctatggcctattctagcacgatttgttgaaaaagactgtctttctttcattaaattgtatttgcacctatgtgagaaattatctggcatatttttgtctctgtttgggttcttcattctgtccactaatccgtgtgtttattcttttttttttttttttttttttttttttttttttttttgagacaaggtcttgctctgtcacacaggctggagtgcagtggcacaatcatagctcattgtaagctcaaactcctgggctcaagtgatcttcccacctcagagcctccagagtagctgggactacataaataatctttgatttctttcatcagcacttttagttttttgcatacaagtcctgtaaatattttgttagttttatatctttttttctgtgattttaaatggtattacattttcattttcagtattcacatatattcattgagaaattgataatttctatttttattttatatcctgtgaccttataaaactaagctcacctattacttctagaatgtgtgtgtgtgtgttttaagattccttgagatttatacatagttatgttaaatgcagagacggacagcattgcttttttgtttgttttttccatttcccatctgtataccttttatctctctttgttattgcatttgctagaattcacagcattaggttgaataacagcagtgacagccaaaatccttggctttgttccagtcataatggaaaacattcagtcttttactattaagtgattttaggtgtttttgtagatgatctttcttaggaagttcctctctattcctagttccctgaaacttttttttttcttttaatcctgagagggtgttgaattttgtcaaatgctttttttgcatcagttgatactgtcatgtggatttttcttctttagcctgttcatatggtggattgcattgatgtttttcagcattaaaccagtcatccagttctggaatgaatctgagttggccatgatgtattatttatatttgtatttacaaacacaataacacatcgctgaattctatttttaatattttgataagttcgtatttatattgatgaggaatctttgtctataattttccttttttgtaatagctttggttttggtatcagggtgattctagcttcataaaatgaaatggaaagtgtttcctccttttctgtgtcctgaaagatattgtgtagaagagatgttaattctttaagatttggtagatttctccatttggacctggagatttactttttgggttcatttttcttccccttgaagaattgattcatctagtcatagttttcaaattttgtgtgtagagttgcttgttttcaaaattaatcttttgataactgcagggtctgtaatgatatcccatttcattccttatattggtaatttatggtttctctctttcttattagagttttttcagttttattgatctttaaaaaacaagttttaaaaatcaaaattttaaatataatttctttattttttaaatttaaaatataaattttgttgatttctgctatctttgttattttttgtccatgcttactttggttttattttgctttccatgtttctggtgttttaggtgagagctagattatggaattaagacttacttgtactgtgcacattcggtgctataaatttctctctctgtactactttagttgtggcccacaaattttgatacattatatcttcattcaatttttttcttctgtttcatttgagaattcctctttggctcatggactatttaggtctgtttagtttccaaatttggggggattttcttactattttttaaaaaattgatttctaatttgaatctaatgtggtctgagaacaaactctgtatagcttcatttattttaattttgttcatttctggcccagtataatattatctaccttgttaggtgttttgtgggcatttgaaaagaatgtgtattctgctgttctataatctagaaacagcttattagttgatggcatttttaacattgttgatatccttgctgatattccgtctatttgttatatttgttgttgagagggtatcgaagtctccaaatataattgtagatttatattttcagctctatctctttctgcttcacatattttatagctatgttgtttggtttatacatatttcaaattgctgtgtcttttcagaggattggctcttataatttttttcctcttaagcctactttatttgacattaaaataaccagtttttttaaaaaaaaattgagataaaattcacataacagaaaacgtatcatacagctattttaaagtatacaattcaggagtttttagcaaattcatatagctgtgcagctttcaccactgtctaagtttagaacatttttatctccccagaagaaaccccataccaattaagcaatcattccccattcctatttccccacagcccttggcaatcactaatctacttagtgtctctgtggaattctgattttgaatattttctataaatggaatcgtggaatatgtaatcttttgtatctggtttatttcactaagcataattttttcaaagtttattcttgttgtagtatgtttcagtacttcatttctttttatggctgaataatatttcatagtatggttatattacattttgtttctccattcattaagagttagatatttgagttgtttccactttttggctattagaaataatggttttatgaacattcttatataagcttttgtgtggacatatatgttcagttctcttggttatctacataggagatgttctgctggatcatatggtcactttctgagtaactgccaaattgttttccatagcagctggaccatatgacattcctagcagcaatgtatgagggtttcaatatctccacatcctcaccaacgcttgttattgtttctctttttattataaccattttacttggtgtgaagtggtagctatgttctaatttttatatattgatgtttatataatctactttttccaccctttcactttcaacttgcctacattgttatatttgaagtgagtttcttattgactctttatatttggagtatgtttctttgatccagtcttccagtcttgtcttttaattgatatattgtgagagcatttatattaaatgcaataattgatatgttagactctatgtctgccattttattttttgctgtttgctatctctgtttttcatttctttttctgtcttcttgtgggttagttgaacattatttgaacattattagaattccattttggcttatgtgcagtaattttaagtgtatctcatcaagctttttaatgattgttttaggtattatatttcacatttctaactcattacagtttactgatattgtgttattccagttcaagtgaaatatagaatctatacttgctcttatgttcctttacccttcctcatggagaaccatatcagatattatttttgcttcaacatgaaacatagtttagaaaacttaagaggagacagaaagtctgtgtactctatttttgcttgctgtattctcccttctctcctgatatcccaaaaatccttattttattcttaactttctgtttggagatctttacctgtccttttactgtagatctgcttatgacacattttttttgtttgttttagtttcccttcatctgagagtgttttgttttctccttcattcctgaagtatatttttgctgaatatagaatttggggtacttttttttaaagcaattgaaaaatgtcatgctatttcctcctggcctctatggtttctaatgaaatatctactgtcatttcatttttccccctctatacataaggtgtagtttttctcttactccattcagtattttttcttttattttcaaaagtttatccatgatgcgttatgatttctttgagtttactctgttaggggctagctcagtttcttaatgtttagattttgtcttttgtcaaatatgggaagttattagcaactattttttaaattaattaatttttaactttattttattttattatattttatttatttatttatttagagacggaatctcactgtgtcacccaggctggagtgccgtggtgtgatctcaactcactgcaatgtctgcccacaggctcaagtgattctcctgcctcagcctcttgagtagctgggatgacaggcacccaccaccatgcctagctgatttttgtattgttattagagacggggtttcaccatgttggccaggctggtcccaaacttctgacctcaggtgatccacccaccttggcctcccaaagtgctgggattacagagccactcttttttgaagtacattttctgtttcatctttttatttttcttgtactggactctgatgacttgaaaggtagatcttttatctaactttctcataggtccttaagactcttttctctttttttccctgtttttttttctatatttcacattgggtaatttctgttgttccctcttccattttaatgattctttccttagccctctccattctggtatggaacccatttattgagtttcttggtttggtcattacatttttcagtactgaaatttgtttgatttgtttttatgtcgttgtccattttcttctcttttttttccctacaaattcctatttctttgccaaaatctattttcatttgcttcaagcaaaatgttaattggagcatttttataatggctgctttaaaatctttctgtgatagttttaccgtctttgtcatctcagtgacatctattatcttttttcattcagtttaggcccttcttggtttttggtacgatgagtgatttttatttgaaacctggatgtttggatattgttttccgagattctgtgttgtgtttaaacctgtgttagctgacttcctctgaaaatgctccagcagtggaagggaacatgcctccacttattactgctaggggatgtacaaatccaggttttccacttggcctgcattgctatttaaggccaggggggattcttgttacttctggcccggggtcaaaattctggctctcagtgaggcctctgttgatacatccctggcttggagtgtttagattgcctcattactgctctaagtgaggcctcccctgatgtcatggtggtgctgaggtggtatgttattgccgcaggttggtaaaatttttgactctccactaggtctctcttgacaccaccccagctgtaagagggaggggcatagtcttacttctaggttgagttaaaagtctaggccttctctttagcctagtcttattctacccaggcagggatgttggggttcatgttagagtatgctgaagatggaagtctaggcttcccacttgatctttgctgttgttggtagtggcaggaccaccatttttagagtggtgtttgggtggaggagaccagtttttgcctaaacattttctgttttgctaggatacctctttctggtcctttggctaaggagaacaggttggggaacttttttctgtctgtacccattggcctttctgggttgctggcttctaggatatatgagcaaaacaaaacccgtgatccttactaccatgacatttgctgggtctacatgtcccttcctttttaaggctgactaatattctattgtatgtatataccacattttgcttatttattcattctttggaatttgggttgcttccatgttctagctattataaatagtgaaactatgaacacaggtatacaaatatctttttgaaactctgtttttaattttgggcacatacttagaagtacaattgctggatcatatggtagttctatgtttaatttcttgaggaatcgcgatactgttttccactgtaccattttacattcccactaacaatatacaagggttccgattactccacatcctggatatcatctgttattattattatttttttaaatagtagccatcctaatgggtatgaagtagtatctctttgtcgttttgatttgcattttcttaattagtaatgctgagcatattttcatgtgcttattatccatttgcatatcttctttggagaaatgtctattcaagtcctttgtccatttttgaagtgggtttttttgttgttatttaggtctagagattatctatgtattctggataccagcgtctcatcagataagtgatttgcagatattttctcagattgtttccctccattttcatagcactctaacttgcaattttcacaatgttgaatatgtatatatttgtgtaatttttttaatgactgcttctctcactagattgtgaatttcatgagagaagagcctgaattggtcttatttacttgtctgactccaggctgagtctggtatagagtagtttcatagtaaatattcattgaatgaatgagagagagaataaaagacatatgaatcaaagttagcaccacacatgaatgaccattagtaaatgatcatgcttaggtgcagacaaaacttgcatccttaagctaggatgaaaatctagtgggcaattacatttcaatgtgagttttggagggaatatatattcaaaccgtagcagcaactgattgccctaaacttaagtgagaaacaggttagagttttgtgcagtagttctttatcatgaattgaagggctctgattgaagtagtaagattggaatcttggttgcacacagagttcttatagtaaaaaaatagcttgttggagtctcgatttcatagttaggtaattagccttgtaggatgacaattttgtgttgtggcattagtgagagtgccttgtggcatacagtgagttaaactaaagaaaggagaataatctgtgcatagtgagtaatgtactcatttttattccagtgtgttctttaccaactccttccaaacagacgtgcatgtgagtgcatgtgtgtacacacacacacacacacacacacgatgtttaaaatatagttttgtctttattatgacttcttttatttctttcagctagtcatttagcttctttagccatgcttcaaatatttttaaaaatctttactgatttctcttattgtgtttataacaaggtgttttaaaatagactctatgtttcctgtgtagtatttttaaatgacctcatttgatttttgccctaatgctgactttttttttttttaagttagtgcccaagagtgatgggtttctctctccttctttccctcttgggctgtcagaatatggggtttactataatatgacttttacatagtagtccttctttagatatttgtaccagtggttattactaagaacttagtttcatgtattttcttcccatatgtattatgaaattaactaatatgagaagcaggcattttgttttttcttgttattattttcatatcaatgccatgtgtttttttaagttcatatatgtggataatgctaaattatcatcatttagttttattttattattttttattattttaaccaataatttaaccaaataacattattattttaaccaataaattttagagaaaaaagcactctaatattgcatcactttgtacttagtttcatgtattttctttccatatgtgttatgaaattgactaatatgagaagcaggcattttgttttttttctcaagttattattttcatatttatgccttttttttaagtttatgtatgtggataatactaaatgatcaccattgggtattattattttaaccaataaattttagagaaaaaaatcactctaatattgcatcactttgttatcggtatcacaacaataattagttatcattcttctcctgacatagctctggagcctatgggggagatatcagagttttggaaagttttccttgcaatatcagtttataaacaaatttatagttattcctttaaaattttatctcagcttttatcactacctgactttgcctagtcaatattttttctaccatatattcaaaaacataactacttcatgtaattaattagcgtaagttttctttgcctctaaaaatgttgaaggtacctgactatattactacctgaaagactgtttatttcatattccattttgtcatatttatggtcttcgatccattgtagataatcatggcttttagagataaaagcaatcatagtcataaccaaatccagtccctgacttttttcaggtgaagaaactgggccacaaagttttaaatgcaacattatacagctttttgatggtagagtttttactagagtaaaggtctagggattagtgtatctttcagtaaactcccttattaatttttaatgtatatgaactgaacttttctaatcccagcttgtattgtttatattaatagtagcaataatgacaatatagtatctgacatttattgagcatttacatgccaaatgcactattaaccactgcccatttattattctactcagtgctcatgattactgtgtgaagtagctagtgatttatgcctgttttacagatgagaaaacttagcgtagtttaataaatttcagggctcatgatgtgtttaatttctttgcatatcctgtagtatttaacctcagaaattatgtttttcttcctcttctatcatggatgaaatcttaggagaaaattcgtttataagctactttttgcttaagaaacatatagcaagacttctaaaaaaatttaaaaaacaaagagaaaatgaaaattagtgttggaagtaggcactgatgctttgtgtgggttcccctaatgttctttggcaaccccactaaccagtggatttggattttgattaccagaagggagtgtgggcaagtaggggggaattggaagtgatattccacttcagtaagctcataatgtcaaagcactagtgaaaagatagaccatttcaaaaatctgtttcactccagatttaacaaagaaggttttttgtgttggccttgattgggaagggagagggtgctttcctggagaatttgtaaccacaactctgtcctcattcagattttaatttcttgcctgacctgggaactactgagctaataagttaaaatgtgatccttagtgggctaattacatccctgagtgtctagtagtaagtacaagtatttgctgtggcacatacccttacctctggcaatgtatgtgaaaaagaaagccttatgaaatgtaaactcataatctaaaattacaaagaatttgaggaaataattcagcaagagtaagagtgagcagaaaccgccagtggccaaattcaacttctgcaatgtcagataatatatcagaaacagtataaaagacttttaaaataattgaagaagtaaaagatggaattcaaattacaagagagacacaagatactatcataaggactacagaatttttataatgaaagaattttttggaggttggaagtccttaatggattaaatggattaaacagcagattagacacagccaaagacgctataagtgaactggaaggtggttataaagaagtttcccagaatgcaacattgaaaatagagatgatatgtgaaatacagtcaacagatctggatgttagaatgaaaagattctttatttctatcaactctcaggaggagaaagtgggagagaagcaatatttattgactttttttcccctgacaaaatagatgtgagatgtgaatcttcagacctgagaatcctaaattccaagtaggaaaaacaaacctaaacctctaagtagacacattgtggtgaaactctggtgtgctaaagataagcatgaacccttaaaagcaaccagagggaaaataaataaatggcatgatctgccaacatatatgttaataattcagtttcctgcagttggtaatgaagatgtcaaggatagagaaaatttatttcttcttgaacatatattatatttgaggcattgtattaacctatttgcaataggttaattggctagaaaggggaggatcactagattggattgaataggatcactagatcacttctttgaagtccacatacaatctagtgatcctcccctttctagccaatgtgagttattgaatcttcttttgagactatatctagaagttacaagttcctcagtattctgaagaaccaaactctgtccccttccaaataaaaatacttaattttctatttctagtctcttgtacccagaaatgttcttattcccacatttggaattatgacatagtagatcaatcaaagttaagtaaataagcttgtaatggaacaagttacttaagtttttctttttttaaaaaaaaacttaattttttttaagagcagttttaggttcacagtacaattgagaagaagatacagagatttcccttatacccccaccccaaaacatgtatagtctctcccctattatcaatatcaatatcccctatcagagtgatacatttgttaccttcatgaacctacactgatgtgtcacaattactcaagtccatagcctactttgggttttactcttagtgttgtacattctatggatttgggaaaatgtacatgttatgtatccatccttatcatatcatatagaatgtttcacagccctaaaatttctctgtgttctacctatttatcctatcccccaccagccaaaccctagcaaccactggtctttttactgtttctgtagttttgccttttcaagattgtagccttttcacattctcttagtaatgtgcgttatcatggcttgatagctcatttctttttagcaataatatttcttgtctggatttaccataatttattcattcacctactaagggacatcttggttgctttcgtgttttggcaactaccagtaaagctgctataaatatctgtttgcaggtttttgtgtggacttgtctcacctcctttgggtagataccaaagagtgtgaatactgaatggtatgataaatgtatgtttagttttgtatgaaactatcaaactgtcttgcagagtgactgtagccattttgcattcccaccaacagtgaatgaggttctgtttctccacatcctcaccagcatttggcattgtcattgaggttaattcttattagtaatgcaaataagttttctaagaatgtatgtggttagtgtgacaaagacatgtaggagagattgtgattcatacaattttagagttagaagcacattttatgtatttatttcatattaagaattatgtcataagcaaggtggcagaatgtattgctttaaattgaggcatttaaaaatcattctgtcactgtgaagctgaacttttacttgtcagatgtttatttgccattgctgtttaaaaaaaagaattacatgtttgtcagtaaatgcttgttgactccttttgctggtgattacagcaatatggacagggatttctgagatgcaagtgggggtagaacgatgaaaattaagctcttactgtacagactttgtgttttgttccttgtgaatatttaaagttcagttctgtcatttaatgatcactgtgagttgtacttttgagattactttttgtttcatgttgtttcagtggttatattttatgttctgctgaaaatagtaagtgctttttacctggatattttgacttaaccctagaatgggtcactacatctgttttttgctgttaaaatcattataatcaacaacaataataaaagtacctctacctttttaagtgtgctgtctcttaaagtttctcttttcagagggagatttttacagtctttgtcacctattgaatcttagaactaactagctttcttggtacacctgtcttattagtatttcctagcgagccacttttatttaggtttttcactttcttcttatgtgataaatcttcccctcatttcactttctccctttattcttcccctgaaaggataatacttacttcttactatatagtatgaaagatttggaagctcttgactatctctttaatgcatcttttaaaataatttacctcttttctctttcagaaacctttattatagttacactctcctgtgattttgttatttcccagtatcaatatggctcctggctgtttgaatgttttggatggtctgttgttgttgttgttgttgttgttgttgttgtttcaaacagggtctggctttgttgctcaggcaagagggtagtggtatgaccatgacgcactgaagcctcaagcaatcctcccacctcagcctcccaagtagctgggaccacaggtgtgtgtcaccatgcctggctaattttttatttttttttgtagagatggggtcccatcatgtagcccagacttgtctcaaactcctgagctcaagtgatcatcctgccttggccccccaaagtgctgggattataggcatgagcttcatctggccaatcttttgttttattttattaaattatagctttgcaaggcttgtaacaaaaagagcagtcttctggcaccctgtcatcctcactgctttttagaggcaatcatttttcaacttattcttagatatgtacctctaaatttctatatagtagtctttgttgcagttttcttatttttgatgtttttccatagagaaagtcagtgttggccctgaaagctaaatcattctctgtgttaggcaggagtatgtagatattatctgcatagttactattgaatatgaggatatattagttttctattgctgctctaacaaattaccataaacttagtcccttgaagcaacacacatttattttcttgcaattacgtagtttagaagactgaaatgggtctcagactaaaatcaaggtgtcagttgggctcctttttacaggctctaagataaaacccctttccctgctttttctagcttttagaaatttcctgaattccttggcctgtgacccccttcccccatctctaaagccagcaatgttacatttccgtgagtgtgcatctgtcatcacatctctttctctgactcttttttgccttctcctactacttttaaggattcttctgattacgttgggttcacctgaataatctaggatcatctccctatttcaaggtcagctgattaggaatctgaattttcctttctgttgtaatatgacatgttcacaggtcctgaggtttagcatatgaacatctttgggggggaccattattctgtctgtcatagaggatctagtttttagggccaatactcatagcctctgtcttttattcctttttcctaaatctttgaatataattatgtcacagtttttgcttaaatctatactcagtatgaacgtattataaacatgtatgtatgagttagaatatgctaccaattgcatttatttttcttataaaacttgtattcttggagttaataactgtcttggagttaataactgtctttttttttgttattgcttgattagtgttctatgtacttatttttaattaattccctcaaactctgacataaacatatcttctctcaattccttcaggtgtgtgagataattacttttaatttttggagtctttttttttttaatgctttttcctcctgtttttctgtttgttccctaggcctactgtagagatgtcttgaaatttccttttatcattgtcctgggatttccttttctccggttggatcccctgtttcttagaccacacatgttactctttcttgatttactctcttttttaggtggagcaaaatcctctagttaccttcctagtgtaggaagtaaacttttttcaggtctgacatgtctgaatgaatctttattttgtctttatatgtaattgattggactgtatatagatttttagggtgggagtgattttcctacagaaatctgaaagcatcacattattgtcttcttgcttttggcatttctgttgagaagtttgatgccattctaattgtttaacctttgtttgtcacctgtttttgtttttatatttgtctgtctgtcttatatcagaagtttttaggagcgtctctttagccttgatgttcaggtggtatgagtttatgtgtgtgtttttttcatttgttaatactggatacatagtaaacacttttaatttgcaactccttttctacagttttggaaatgctcttgaactatgtttttgattattttccccattttcttttaatagttccttctagaccttttggtttttagatattggattgcttatgttgatcttttcatttttcttccattttcattctctttggattttttggttttaatttatgggagattttctcaactttattttccaatctatttattaatttaaagagaactagcatcatgtttttaatttctatgtgcttgtttttgttgtttgaatattttaaataaatgttcatttcttattgcagtatcttctgtactctttgaggatagaaatcattattattattattatttgaagttttcttctgctcctggctttgtctgtttaccccatgttccttttattatgttttaaaataatatctgcctgtcacatttgtgatttccatctaatatttaacaatccttcatattgcagaatgaagtacaaaataactgaaacctctgtgtgaggttggaacttgttgattgtaggggaattggacacaattcatttttggtttgaggataatcgattatcagtgtcatgtttcctttttcttgagcttgctcgtttcagagagaaagccgtccatttccttcttgaggtttctaagcctggtacttagtaaaggaagggtagatctcattatccagtatgtgtatgccatatagattctaagataattccccccttttagcatatggttgtatctcatattccttagttgagagtcctcctggtttaacctctccaaagtaaaccctttagtcttctgccaggtgagtgtcaggtagttactgggctgcgtggattaaaggagaggatcctacatggattaagaaaaacgatctgtagtcactagataaaattttagtcatgcctcatctttttagcctcatctgcatccctgccttcagagcttcctggcctctttttaattcttatatttctggggcttattgcaggatctatttgcttattagcttaattacccacaggcacttttctctgttctactaaggctactcattgctacttgttcatcagatatccatctttcaaaatttagatgatagctcttgcttgtttgagagcggcctatttggctcttgtctttttattttcgtttctttgttagtttagcgccttaaaataatttcttaatagtcttttggtggacttcagtgggggaacagaagtaatcatatggtttgactccttaatcttttacttccacagagatatacagatcattctcattagttcatcatttaatatgtacatcataactacagaagtgatcataagctgactactgaacactagaaagttgacactgagggagaggtctcagtgagtcttaaagaattatagcgggcaagaaggttggtggaaaaagaattagggttagcctgggcaccatagtgagaccctgtctctacaaaaaaaaaacaggtgtgatagagtacatgcctgtagtcccagctacccaggaggctgagatgggaggatcacttgagcccaggagctcgatattacagtgagctatgattgcactactgcactccagcctgggcaacagagtgagactctgtctcttaaaaaaaagaaaaaaaaataggtttaatggtgcaccacaggactaagattatgtgttaggagttgatatttttcagaaaagtactaggaggatgatatgatttggctgtgtccctgcacagatctcatcttgatttatagttcccataattcccacatgtcacgggagatacctggtgggaggtaattgaatcatggggggtggttaccctcatgctgttcttgtggtagtgagttctagagggacgtgatggtaggtaattgaatcatggaggtggttaccttcatgctgttcttgtgatagtgagtgagttctcaggagatctgatagttttataagcagtttttccccctttgcttagctcttctccctcctgctgcattgtgaagaggattagtttgtttccccttctgtgatggccttcccagctatgtagaactgtgagtcaatcaaacctcttttctttataaattacccagtcttgggtatttcttcatagcagcatgagaatggactcatacagcaaattgataccagtagggtagggtgctgctataaggatacctgaaaatttggaagctactttggaactgggtaacagacagagattggaaaagtttagaggactcagaagaagacaggaaaatgtgggaaagtttggaacttcctagagctttggaaggctcacaggacaggaagatctgggaaagtttggaacttcctagagacttgttgagtggctttgactaaaatgctgacagtgatatggacaatgaagtctgggttgaggtggtctcagatggagatgaggaacttgttgggaactggagaaaagttaactcttgctgtgctttagtaaagagactggtggctttttgctcctgccctggagatctgtggaactttgaacttgagagagatgatttggggtatctggcagaagaaatttctaagtggcaaagcattcaagagtaggcagaacataaaagtttggaaaatatgcagcctgattatgcgatagaaaagaaaaacccggctggacacgatggctcatgcctgtattcccagcactttgggaggctgaggtgggaagatcaaaagatcaggagatcgagaccatcctggctaacatggagaaacccttctctactaaaaatacaaaaattagtggggcatggtagcgcatgcctataatcccagctacttgggaggctgaggcaggagaatcgcttgaaccagggggtctgaggttgcagtgagctgagatcttgccactgcactccagcctggcgacagagtgagactccgtcaaaaaaaaaaaagaaaaaagaaaaaagaaaaacccattttctggggagaaagtgaagctggccacaaaaatttgcataagtaatgaggagcagaatgttaatcaccaagacaatggggaaaatgtctccagggcatgtcagagaccttcatgagagtccttcccatcacaggccaggaggtctaggagggaaaaatggttttgtgggctgggtgcagagtccagctcccttgctgtgtgcagccttagtactctgtccccgccattctagtcatgggcaaaaggggtcaaggtagagctcaggatgttgcttcagagggtgtaagcccccagctttgggaggttccacgtggtattggtcctgagagtacacagaagacaaaaattgaggtttgggaacctctgcttagatttcagaggatgtgtggaaatgcctggatgtcgactcagaagtctgctacaggggcagagccctcatggagaacctctgttagggcagtgtggaagggaaatgtgaggccagagcccccacacagagtccctactggggcactgcctactgggctgtgagaagagggccactgtcctccagaccccagaattgtagatccactgatatcttgcaccatgtggccggagaagctgcagacagtcaatgccagcctgtgaaagcagccaagagtgggagttgtaacctgcaaagccatagggacagagctgcccaaggctgtgggagcccatctcttgcaacagtgtgatctggatatgagacatggagtaaaaggagatcattttggaactttaagatttaatgactgccctattggattttagacttccatgggctgtaactcctttgttttggccaatttctcccatttggaatggatgtatttgcccagtgtctgtacccccattgtatctaggaagttacaggctcataggcaggaggaacttgctttgtctcagatgagactttggacttggagttttgagttaatgctgaaatgagttaagactttgggggagttttggaagggcatgagtgttttgaagcatgagaacatgggattttgggggggccagggtagaaggatatggtttggctgtgtctccacccaaatctcatcttgaattgtagttcccataatcctcatgtgttgtgggagggacccagtgggaggtagttggatcatggaggtggttaccctcatgctgttcttgtgatagtgagtgagttcttaggagatctgatggtgttataaggggcttttccccctttgcttggcacttctctctcctgccaccttgtgaagaaggacgtgtttgcttcccttccatcatgattgtaagtttcctgagccttcccagccacatggaactgtgactcaattaaacctctttcctttataaattacccagtctcgagtatttctttatagcagcatgaggatggactaatacagaggaggaaaataacagtgcattattctatatttaattttattataaaaattggtaattatttttagattattgtattgactgtgcagtataacttatatgtcaattgcagtaccttagggatacctctttccttcctctagtggactatgacaacaggatttgagtaaaggaataggtgaatactttataaagcattttttcaaatgtgggtattttcactatctttgtgattgtccttttgactcatgtcagctttctttacatcctacaaaagcattatactctctttctaaattaagttctgtataaagtttagccaagttctcagagttaagcacctggaacaataactacagttattttggcctccttaagtaacaataataaatagtgactagccttaagccactgtattacaaggtaaagaatgctgcctatatctgaagccacattttagcttatttgctctttttgtttcaccacattgcttccctaatagtaaatttcttttcacagtttctgagagaagtattcctgtgagtggtgccctgagttgtataatgtcaagactgtactcctttctgcctttctattgctcacatttggggcattttataatttcagtttgatggtagagtggaaagaaactacgattatttttactagctacttttctctatttgatatcaatgtctatcaagagatgaatataacttttatataaaaatcccttccttataaaaatctgagcttttagcactaaaaacaaattactttataaaaaacttttcttaaggagaaattatgacattatgttcttttagttgttaaaccaaatttaaaaatacttgagaaatgtaaagttaaaagtgtcaaactgtattcttgattgtagttgtctaaatcaaagtgctttatataggtatataagatataagaatcttttttttttttttttttttttttttgagacagagtcttgctcgttgcccagactggagtgcagtggtgtgatctcggctcactgcaacctctgcctcccaggctcaggcaatttttgtgcctcagcctcctgattagctggaattacaggtgcttgccaccatgcttggctaatttttatacttttagtatagatgtggtttctccacattggccaggctggtcttaaactcctgacctcaagtgatcctcctgccttggcctcccaaagtgttgggattacaggcgtgagccaccgcgcctggccaagattgttatcagaagatgtttcagataacttatgataagagtcttatatataacatgtatgagatattaagaaatacttattatttatgattcaaggtagagtattaagttttggaaactgtaaaagaagccgtgttataaaataattctaaagaaactcatttggtctatccatattcttttgctcttgtatataccggaaactaattcagatttttggttctgaacaccatcaacgactctttagagaatcttttagtagctcttgtttgctgactactatataggtttcctgtatttcttttgaaaaaattggtattgaatgagagtttgacccttaaggcttgagagccaggggagggaaggctattattaagttctgtttctctctcatcatctaacatagtgattggaacagggtaagttatctattgattatagctccctgcaaccacagtagatgttaaatagagtagctcagcatcctttgttataaagaaaaatgagatccaggctttgccactttctgacttgggcctttgcaaaatccttatttctccaatccttttttaaatatatatatagaatgaaaatagtaatagctcctaaggattattttgtgtttgccgaataaatgaaataaactaggcatcatgcatggcactcagtaagtgctcagtgcatgttaagtgctatgattactattattgatactactgctgctgcttttattgctgctgctgctgctaccactaactactactactactactactactactactactactactactactactactacgatgatgattgtattagcatttttggcatcatttaattttctgagatattaaaatttcctgagacatgaattttgagaatctgttaaaaatgctttaaaatgcataaatatacagcattttagataccatttcataggtgtaatgaactctttaaagtgtgctctagaccataggtttagaactccttctcagaggataatggataccacttcaaatggacacaattcaggtggcaaatattggaaaatagcaaccaattagtacacaattatataaagacaaaatacaaattagcaaattgatagctccgagtattagtccgttcgcatactgctgtaaagaactgcctgagactgggtaatttaaaaaggaaagacacttgattgactcacagttccacatggctagggagggctcaggaaacttacaattatggcagaatgcgaaggggaagcaagtaccttcttcacatggtggcaggagagagaattgccaacgaatgaggaagtgccatgctttaaaaaccgttagatcttgtgagaactccctcactatcatgagaacagcatgagggaaactgctcccataatccagttacttcccacctggttcttcccttaaaaccttgggattataattcaacatggggtttgggtggggacacaaagctaaacaatatcataagggttgatttgggacaaggtatttctcaggataacattctctaaccatttgcaaatcatttaatgtgcttgttaaatgcagaattctgggccatagctcaggatgactgaatcataatttctttgagagattatgagtcttcttgaataccctagagtttaaagtcaaggattttagaataatgtttaatacaactatcatagaaagtgtatgatcttcttaattattcatacatagttaaagaagcttcaaaaataaaggatggaattatttaaccaaagtgtggaaagggaaaaagaagcaaaattacgttggtgggttttcatgaataattggcaaaatgagtgataaagtcttctgtgatggaatcagattgtgttaaacaccctagatctttcacatagcaactgttgtcctctgggcaaaaattagttaccttccctaatctattgcatcctcaatctgtaaagtgaagataataataatatctataatataggcctgttgtaaggactgaatgagataatgtacataacacatacttaagtcctcagtaaatgttaattgattagagttaattgtcattatcatcatcatcatcactatcatcaccattttagtggtggttgtccatactgtcagtataatattcttaaggtttctttgcctgtataattctcacctacccttaaggatcaaaatgaggttctcccttttgattaagttttccaaccatttatttatgggaattattaccttctgtgcttttatatcctttagcaagtagtacataataaagatgttaatatctactttttggttaatttataaaaatttatttgcttcctttttatctatacagagcatgtgaattttatttataagctattgtattttaacacaggaattatttgagctacaggttgagtgaccccctactctgaaaattcaaaatctgaaatgttctaaaatctgaaactttttgagagccaatattgactctcaaaggaaatgttcattggagcacttttgatttttgattttcagaatggggatgctctactgttaagtatataatacaaatattccaaaattcagcaaaatccaaaattcaggacacttctgctcccaagtattttggataagggatcctcaacctgtattttgtttctgtttcctcatttcacctgaccaaaatatttcagagaatttgtttactcaggtagttttttttttttttttttgagatggagtctctctctgtcgctaggctggagtgcagtggtgcgacctctgctcactgcaacctctgcctcccgggttcaggtgattctcctgcctcagcctcccgagcagctcggaccacaggcgcatgccaccacgcccagctaatttttgtactttttttttttttagtagagatggggtttcaccatgttgaccaggatggtctcgatctcttgacctcgtgatccgcttgcctaggcctgccaaagtgctgggattacaggcgtgagtcaccgcgcccagccttgcttgggtagttttatgtttaaatgtctccacctaggccgggcctggtggtgcacgcctgtaatcctagcactttggaaggctgagttgggtggatcacctgaggtcaggagttcaagaccagcctggccaacatgctgaaaccgcgtctctactaaaaatacaaaaattagccaggctggtggaatgcgcccgtaatcccaactactagggagtctgaggaaggagaattgcttgaacccgggaggcagagcttgcagagcttgcagtgagctgagattgcaccactgcactccagcctgggtgacagagtgagactctgtctcaaaaaaaaataaaaaataaaaaataaagtcttcgcctaaattaaacttgactttataagttaaatttgtttcaaaaagaaaaatcttattgttttctaaaaccaaatatgatttttaaaattatttcttgttttttttaaaaagtatttgtgcatttacttttatttcttgagcttgactaatcaagaattgaatgcataagtatagttatgagagttcagcccatttattttaaatttgcatcctttcacctctgaaatactaaactatgaaacctaacacaaatactgtaagaacatctgaggtagacagttagagtataattaagtttaaatgccttggtgaaggaatataaaaattatttaaattcaatcggctagtacatttgcagttttcttttattaggtgtgaaatctaagaatcccctgccaactcttgagggctcaatccagaatgttgaattgaagtactgcagcacatcattggtcaaatgtgcctctgggaccatgggatcaataaaaatttgtgccaaagccccaggtatgtgcagctggaccgtgtaaaactttattgcctgtataggagaattggccttgcgttttacaaggagcgttactgaaacaagaatttactcactgttgctatgaatcagacgttttaaatttttacttagaaatttttctaattgtgccaggatggtacttcttgactttaacaaatttttatttagggaaaaatacttagttttatgaatggttatgagggagaaaaattaaaggaatgtttattatactttttgggggaataggaggtgtatatatatgtatataatatgacacttaaaattaaattaaaaagttgttattgtaatataattaaataggagacccagttgtttttaaattttggttgtaaatgactttaccttcctaccaatattttatttcataatatattttaaaaaccatttgtgatttttttcagtgcaaactaaatttaaggtaagtttataaaagtccagatttcatttaatttttagaagacagtgtgtttagttgtttccttttataagcttttctggacatgttctgcattcattagcaaatatgaaaacttaagagttaaaaatgctttacattttatgagactcagtataattaaatgtatagctaatattatcaaataaagttgaaatgttatattatggtgttagtatattttaaaatcaaacattctcaagtgactcatgttttatttttattattgttttataaatatttcttttcagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtaagtacaaacctatcattattcccttgttttgcttttttttttttttttttccagaaaggcttttaaaattggtatatatttttttttttttaggtatttttgtcaattggcttactctgcagttgtgctttttcaaaattcaaatgaagaatttttgtatcacttttgttaattgaaatgtgtttataaataatgattttatttatatgagagaatttagctgtgtgtatagtggttaacttcagattcgtatatataaggaacaactgagttttaaaatatagcatatcattataatgcatattttcttgagatagtagcactttgtaacccaagtttgtcatgtgtaaattggtgtttttaccttctgtaattttttaggaatgaaaagatttgatggtagaactgagaagaaaatctcagaggtcattatctcatttcttagagttttatttttttctggtagcactttgaatagaatcgatttcattttattcaacactgtaatagcagagctatacctctcatgttgagagaaggtatcagaaggatcaatgaagactgagaaaagaaaaatgtatgataggtagagatcactatcagccatgaattcacttagccagtatgtggttagcaaagtcagggtgttcagtcaatgaagctagcaacgtgatagtaatatagacatttgttttaaaagatacgtggtccacattttctctctagaagtaactggccagtgagtagtttcaaatagctgctttagagtagagcttcattaacattattcaacaagtactgtagcttatagaaagtatgttcagcactagtatgttcaagtggaaactatgaaaagatttgcaactaactgagcagagactatgtagaggtaaatattgaataaagcagtgcacaaatgaatatatacagggacacaaaacatttgaaagatgagtatattatgataatatttgcagttgagtggtatccacattgaaaactggaaattagtatttgaaaggtgagtctaaggatgctgtctgtcagcatgcttcaaaggacagcacacctcaaaaataagatttcagcctggtaagaatgggtacagaaccataaagaatgaatgatcagaggatggctccagatccaaagtagggttgtccctatagagaaaagattttaccaatcttttaagacagggattggtaaatactttcttaaagggcctgacagctaatattttagggtttatggcccatacagtctctgtctcaactgtttctgctgttttagcacaaaaatagctacagacaaaacttaaatgaatggacgtgactgtgtttcaataaagctttatttataaaagcaggaagtgggccagatttggcctatgtggtttgtctaacatggttataagaagaaggaattggtggataaatatcatgactttgttaatgcctatttaatcatgttccttaaatatattgtttagtaaacttctttatagaattacccatatagtaatttttgttttcaaataataaacttaagatgatactaaaatgaccagaccattcagttacaattttgatacctaagaagagattaatctttctagaatcttgccacttgttcttgagttggacaggaactcttaatatttgttttaccacatatacaatgaaaataaattaataagttgagtgtatttaaataatctgttcttcaacaatatattaccttttataatttaaatgcatttctagggtcacaaaattttatttttgtttttaactttttatatagctctaaaagtaaagtggtataagaaaaattatctgtgacacctataatatttataaagttttaattttttcttgctgttaaggaaattcacctaatctgcaacattagtgttatggatagtagtatgtttatggatttgtgtgtaaaattttaatgtgatcatgtatttaatgctttgaaaatattcctttgggtatgttttgaacctaaaatgtaatatattttaacttaaaactacattcacatagtttatttatggtatttttaaatttaaatttttcatccaccttacaactgccacccacattcatggcttaggtatttatgatatggtttagagagctcataagtactatttttatgccagttttaaaataatttgaattaatcttatgttcttgtaacaagatttaatttgggtgtatatgtatatatgtgagtatgattgatgttatagacaagtcataagtaaatcttaaatgaaaaaatcaaaattccttaacagtccttcaagactttacaaaaatattatactttcagcaactactttcctgaccactgtatctaaatttctctctctgtctcctacacacatattgacacttcttacttatttttctacactcctttagttttccttagtacttatcagaatctaccatactatatatgttactgatttatattgttgattgtttcccctgctattagaattttatgcttcatttgggcaggacgttttgtctctttttggtcactactgtgttcccagcatctagaccaatacctggcacataagctaacaataaatacttattgaatgaataagcaagtaactgatgattacatttacttttctttgctttttgaagttgaagtatctaatggaatagagacaggaatctttctggaggcttaagggaagaaaaagatgttaggtggttaaatcttttaggtgaacagttaaagggaatcatgagtggtctctgcttgtgttttcagaaacagatagatgtcccggtgaggttgttaatgaacttttcccatggtcttatagaatttgaatgatgatcatactaactggctttttttgggtcatggcatgatgtgtggaagacagctgcccttgtgcatatactctcaaattgagggggatgggtggttaaatgggaccagcaaatgttgcagatgttacgtaaaagtcaattaggaagtgagttttgagaggagcttattacttaggcagccttttgactgtgatttgagaatgtgagggaatggacagctttattaatggggatttggaattatgacagagagaaatattaatggtattagtaaaactcattataaaaacagtactttacaattaaaatgtcacatttgtgtaaattgttttatttgcttacaaatcaaaactgttttaggcagagaaaatattatttgtgtcttgcagaggaggaaatagatgcctagaagttcaatgacttgtccaattgcctagcaagtcagtctttgaactagaacttggaacttctaactatacaacattttcccaccatgttgggtgttgggctgtttatcattttctcttttaaccttagaatccacctcactaaacactgtatccttcagtcttaaaagttcctaacgtaacggatctccttttttactttatattaagcactgtcaaaagagccacactgtcatgatcttacagcatttctttgtctttgaagtctcagcaattccctttacacttttcccacttccttccttgattgcattctgcacttgactaactctgattaacagcaaaggagctgaaggctcttattagaatacagtatgccagcacacattctgtatttatggttatttttcaggggaaccatttaatgacacatttcttaggtttgtgtagatacaacaggtcacatagagaaatagatgcttctctggttcctttgtaggtagaagcacttggtgactataactgacataattaaaacatttaaaaataggttctgcaggtgcagtggctcatccctgtaatcccagcactttgggagggctgaggtggaagcatcacttgagcctgggaggcagaggttgcggtgagccaagatcacgtactgcactgtagcctgggtgacagaacgcaaccctgtctcaaaaataaataaaaataaaaatgaggttctaaatattttcttcccttattttttattattattattttttagacagaacgttgcccaggctggagtgcagtgggcgcgatctcagctcactgcaacctccgcttcctgggttcaaatgattctcatgccttacagaggcgcaccaccacacctggctaatttttgtatttttagtaaagatggggtttcaccatgctggtcaggctgctcttgaactcctggcctcacgtaatccacccgccttggcctcccaaagtgcttgagattacaggcatgagccactgtgcccagactcccttgtctttttaatatagactttggctcttcttatgctatattttgcctatgattcatagcaggttctgcttgctaaagagttctgagtctttgttaatcatggtattaatgtgtaaataaattttggagtgtctgctatttaggaatataaaatgaccatgaattctatcagcttagaatcaaaagaatttaggccatcatttcaatttctgttttttcttttgatatggagtctcgtactgtcgcccaggctggagtgcagtggcgcgatcttggctcactgcaacctccgcctcccaggttcatgccattctcctgcctcagcctcccaagtagctgggactacaggcacctgttaccatgcccggctaattttttgtatttttagtagagacagggtttcactgtgttagccaggaaggtctcgatctcctgacctcgtgatccacctgcctctgcctgccaaagtcctgggattacaggcgtaagccatcgcaccaggcccatcatttcaatttctgagccagtgttaagagttctatttacatgtctcctgctctctctttgctctggctctgctggccttttttgatgttctctgtggtggttatgtatttacatatactgtttttttctgtctaggattctcacaaccatccttaccctttttatacctgtttatttccagctcagtctcaagatctcagctcaactactgtttctccaaggaagccttctgtgactctgccttttccctactccctcccaagccactcaatttaattaagtacctctcttacattctttcatagctgttaagacggtatatatttatatatgtccttaccacttgacagtaagttccatgagggcagaattaatcactggctgcttaccattttatctccagggcctatcattgatgaatgcacaaagaatgcatgagaaatcgtttgttgaatgaatgaataaatgaatgaacatttatgacagatgttcaagggtataaatttgacagataaataatcagttcttgatacatgttagccgccttttcttttctctatttctgtttcttcctcctcttccttttccttctgcatatatctaccactagagaaaatatctaccaatatctttctctgtaagacagttctaattactattagattatttattcactggactatacctcccatttcctggtctgattttattcttataaatgacatgaaataatatatcagcctgaaatatacctgacaacacatattatcttacctttcttagctttttttcacccttcctttcatttggtattcatcctctttagtctccagcatttactgctatggttgatcataccctttctattcaatccttagtctcttttggcttctagatgttcagagacaagtctctatagcagtggtcctcaactgttttggcgccagggacctgcttcatggaagacaatttttcaatagacttgggtggtgggggatggtttccagataatactcttccaactcagatcatcaggcattagattgtcataaggaatgtgcaagctagatccctcgcgtgcacatttcacaacaggctttgtgctcctatgagcatctaatgctgctgctgatctgacaggaggcagagctcaggcagtaattcttgcttgcctgcccactcctcacctcctgctgtgtggcccagttcctaacaggccacggactagtacaggtccatggcccaggggttggggaccgctgatcgataggtcttttttgtttttgcacttcttgcgaatggaggcactgactgccctttgttctggactgtctattcagagatgttcttatagtgaacagccttggaagacaagtatcatgtctcattctggagcaaagagaaagcatgcttcctgttataaaacatttggttccttaacttcgggttcatctcctgttatgtaattcactgcatgtacaggcagccatctgaacaaacgtgcacatcatcacctctgtgagacttgtgggcaaagggaactgatgcaaatatgttgatactggtgttgctccctgtgcgataagtaataaagtccttatctgtgacttgggatccttgtcttctgcagccttcatgaaactgtggtagcgtatgatcttaggtccctgacaattcttgacaccagaacaatgtcgtttcttggttttccttgctttgttcccctcctcgaagatgtttctttcttctgttccttaaatgtaggttgttaccaagattatgttattgaccctgtctttgtatctgaatgatctaatcaatacatctgttttcagcaaccaaccataagtttatatctttctgtccatttttttttcttttgagatctggactgcaaatttcagctgcttcttaaatattttctttggatattttagtggtgcctaacacattcaaaactaaactcagtataattttttattccctatttcatacttcattattcactctttcagttaataatggcactatttccctcttaatactgtcaatttcagcactaccttgattctgccttctttcttccctgcacatggttgatgttttacaaaagcctccaccaccccaccaattaaatatcctaggcaaaacatcataaatttatttcagtaattttctatatgatttgtcttcagattgtcaaactgactacttccactacatgtttgaaaatatcttctttaaaatgttaactccaaaatttaacacagtcttccacataccacaaagtacaatatatatacttctcagatttgtatagggaacttctattcagttgctatttgtcttgagcttgtatgctacttggaaaccgtggatctttttcacacgaactactcttaagacatttttacatattttatatgtctacattagtttatgaacctacttggaaagctttatacttatttctatgaaatttcacctaattgattttggtccaccattaatgaagatgataccttttaaagtatctgcttagctgtagtcacttgtgcaattcagatgcacatgctatttttgcttttaatataatggaactaaaaataacgttttttactaaggtaagaaaaatagatttatgtgattatgatgttattttaaaataatttaaaataagtgttcctcttaacgtatctttaaatgtaatgccaatgtaaaccagtctttattatcttgtataatttgtttcagaattaagtagtataaattttttaactttaccaaattgtgataaattaaaaataatttaaaattttacccatcgcacatgggaaacttttggtcattgttattggaaaggaaagccacaattacaactctaatctctgtaaattaactgttacattgggaggtagttctttgtcttgattaaaacataccagcaaacagacacactcttttggttcaccatttggagttggttggttagaatatattgtttaggagttttaaaaatggagacagtattttatattgtaagttttaatttgtagggaatgtcttttttggtttcaaaaaattctgctcctaatgtagaaataagtgaattgccttgaagttatatgtttagtatttttgacagaacatatgagtaagaatgcttatatattgtagcaattaaagacaattcacatttgtggtttgggcataaatgtgtaaaaattatacccatctatcttattacatttcctctttcctccctgaggacgttactatgtattttatctgtaattgttgccagttttctatcacgttcccactgggcttttggtgcaaaaaatcttatcctcttgatgacagagcttgcctgaatgatttcatgctcctagcatttttgttcacgggaattaggggcaaaatgtaactacagctgaacagagcgtctatttttgtaattttggagtttaggctctgttattggaactaaatgaagagatgcaggtgttctccagtccaagccctttgggagttttgatggtagatgcttgaaaagaaaatgcatgtgtttccacagtcaaacagcagctgtgagacaaggatttatgcttttctcagaactttgggatttcaaaatgttacatttaatcacaagcccagaaaggggagcaaatgttaaagatgttacgcataaaagtaagtttactgatttctttaccatacgaactagttgtgggaacataggaacaaagtactttttaatcataatgcaaacaatttctaaaggattatgataattgtaaggacattgccttttgaaaatgttacatttgtagtgcagagaatttttttatcctactaatttcctaaaatatattgatattttttcccgttaagagatgcaaacacatacacacacaagacgaaaggtgtggtaaactatttgccatatgcattttaatttttttccccaaaaagtttaataaatatcttattgtaaaaacaatattttcaagtactagaaatgtcaagttctagctaggatactaactaagggaatttatagatatttaaatacaggtgtatatttaaatgtttacacaaaacaaagcatatgtatatgtttaaaatattttttcttttttcagatcatgaaattactttgtgttagttgattttcaaatttatctttattaaagcaccaccttgcagtatttctttgccattctcctatttttattgctctacttttttagcataatcattcatttattcatctaacaagtatttattgcctattttttgtgcgtagaactataacgatgcatcaaagtctctacagtgaatcaacttctaatgaggagtaagcatataaacaactacagctgaataaatgaatgatataaaggcttattttttgggttcagcttcatccattataaattatgttactttgagcaagtaaacctttctgagtattggtttctttttttctttacttttttttttgagatagaatctcactctgtcatccaggaaggagtgcagtggtgcttgcatcctctacctcctgggcccaagagatcctcctccctcagtctcctgaatagctatgactacaggcatgagctgccacacctggctaaatttgtgtgtgtgtgtgtgtttttgtagagacagagtcccactatgttgcccaggttggtcttgaactcctacgttcaagcgatctttccaccttggcctcccaaagtgctgggcttataggcgtgagccacagcacctggcctagtgttggtttgtcacctataaaatggagatactcttatctgcttactaagattgttgtgaagattaaatactgtatcctcaagtacattgtaaactttaaaacataatgtggattttaagtattaattattcttttcacaatagtaccctatattaaccagtgattgaaaatgtaaggtttttctgagtcatttcttttccttccttaatctcaacatcccagttaatggaatccactttaaattttttctcaaggtaaaaatttgcaaacctatgattatgcatttctgaagctaggagcaaatcctttacctagtttcgttattctccttccacattgaaatgtaccctggacgctatgatgttaggagtcaggaacagttgcaatagcaacaggaaattactttgcttgcttcctttgaaaggtcccagattctggaaggatgccagagggagaaatcccttgagccttaagggtaaccagtttccctcatttatatagcacaaggtcaaattttttgcattttattactgcttgtatagtaaaagtaaactggtattcagagtaaatagtagcttcattagtaagtagtaaattagtatacaaaaagtattcgggttgtatactgggctgcaggtgaacttcactagaaaatacggactatctcataatttgtttaaagtatgttttatatggatcaaaaaggtaccagtattactttattttctacttagaaaataatatacattttctatgtgagtttttatttttgcaactcatagcttttgtgtttaagacccaatgacattagccttgtgatcctgtgcagattttgaagttggctgtatagtagctttcatataggccaaaagaggagttgctttataaaacacttacgggtgaaattcacatcaatctttgctacctgccccttctcctagttgttctataccctctagaaaaaacctcattctactgacagcctttgcattccttttattcagttcagtatacatgggagtcattcttataccattgcattgttttgtaaataagtgagactcagttgtctgttaatgtgtgagagtttaagtgttttactgaggatatttctgttttattttcacctccctctgacttttgcccttcctcctccccatccctttcctctcccctcccttcccaattaattactcccttctaagcacaaccatagcacttttgctgtatcatgctgcaaatagtcttaactatttataggattccttccccatgaagttgggagttcttaacagcagggaaccataactagtgtatgataggtattcagtaaatgtaggctggtccaaaggaaattatttttgccatttgggcatagccctattgttcgcaggtacatatttcatttctgaattgctctatggggaaaaatgtagtctggcttcggtctgttaaagaataatttttaaatgtaaaatcataactctcatatagaaataagacaagtgctaaagattttatttaactcatcattaatgagagaaccaggcatatgttacaactagatcaaaggagaatttaaaaaacagaggcatttgttgatcagtaatatcaaaatagatttggaaatgaacaaactggcttttcccttaatggggaaatgagatcaattgaacttctacctgacagaatttgcgtaccttcagtcaataattattttgcattgctatcagttatctataatttactgatttgtaaaatagtgtaaaggcaatgaaaggtgcagagtaacatagagtcagaatcagataacctgcaagggtgtgcttttaaaaacacagagctctacattgaagcacaagttatttcctaagaggcttgctaaattccagatggctaggatatttctagctatgggtggtttaaatatagaggcagatcagaaataattttgtgaaggtttagtgcatggtgggaaaattaaagagaaatgataccaccggcagagggcagtaatgaaataacagttttttgaagacaaaggaaatattgattgttgataattctgggataattctgttgaccttaacttgagttttacttttcaaatattgccgtactaggttcctttcagccagctgctttgccaatacctggaacgtgccagaataaggctcattttggttttgttttaggctttgttaatgaagtaaataaataaaatattctaacctggttttagttaagtaaataatgtgttctaacttctaagtactttttctgtatggcagatatttgagtatctgttgtagattaggtgttgctttaggtattaaggagatatatgtgtgtgtgtatctatctgtctgtctatctatctatctatctatctatctatctatctatctatctatctatctatctctccctccgtactgtatagatagatagatacatctccttatctatgatgagttatgatatgatctatgatagatggatatatgtagctatctacacacatgagagtttccaagcctcaccaaagtaacattctgttgattatgatattttaattttagtagttaatttattctattttttatgagaataaaacacttaatatagtattatttaaactatcagaagtctttctttgaatgtaataatgacatcatctaatttccactaaaagataaaaatctaaaatattgtgaaaatatctatctggaaatatatgatagccaaagttatataaaacttagttatagataaataataaaaatgcaaatacaccataggaaaatggccaaaggggacaaaagtaagaagcacaaatgatcaaaacacataaaaaattcaaattaacaagtagtcaaagaaatcgacattaaaacactaaggaacatttttttacctgtgaaattgataaatgtttactaaatgataaaacaaagctgaggaatttataatgagatgagtatgtccataaaagtctggcaggtgtatgaattagtacagagcctctaaaaatcaatttagcgaagtttatgaagaatttaagagtggttatcttttataatcccacttctaaaactatatcccaagtgagtaatccaagatgcgtttgaaagacttatatttgaagtataagggtatttatgtcagcttatttatgataatcacaaattatctttgttgtctaatagtaggcaaattacctaataaatcagtatattcctagaaggatattgatgtcaaaggaaaatgttcatattaaaagcttgtgtgaaaaaataaaagtataaacctacatataagattccagttttgtaaaatttcttcagtatatacatatgaatatatgcatgcatgtatatttatgtattcataaaaattacttttaatagtgattaccagtgcttaatgggattatgggtcaactcccagtcatacttttactcttctatgttttttgatattttctgcaaacataatagatattaaaaaatatttcttctccagaattacttattttcaaccaattatttagagagaattatggttatttggctcacacatagcattcttgcacacttaattcttatataacctttaataatgaaatacaatttcatttttaaagaatatatataccctgaaagtcacagagtctatagctcaatttttgaagatgctttgaggggcaagtgggaggggtctcaatatgtatgtgaataaaataccaaattttaagatatcataatttacatttctctttgaatagttttagtctagtgactaaaatatttaaaataactttatttttctgataattgttttctaattataaataaaatgtgtcttctttttgatgtatagttggaattttatcattagtcaactatcaggtatagtacaaatcaaaagaaccttcaatgacttatgatccagcatccagatattcacttgaaaaatagctctttgactatttgcatgtattttgacataggaacaaagatattgattgtcatagttaaactccaagttcagctgggtgtggtagttcatgcctataatctcagcactttgggaggctgaggtggaaggatcacttgagtccaggagtttgagaccagcctggacaacatagtgagacccctgcctctatgaatgaatgaatgaatgaatgaatgaatgaaagaaggaaggaaggaaggaaagaaagaaagaaaaagaaagaaagaaagggaaatcagggtcaactcatgaaatctttttttgttaaaccttcgataaagttgaaattttccaaattcttaatggaaactaatggaagttaatactctagataatgatcttacaggaagagttaagaacaatagtaaatttgaataatatctaaaatcatctaacttcaggtaaaataggtttagttaggagaatgctatatatacttctgtagagacactatcaaagtatttttcagtgtatctataataggacattagagtttgatgatattgccgttcttttttgtttttaccctcacttccagtcagttcctgtcttcttgatttgggctttatttagaattattagctatggttagtgttactttgggctcaagttgagaactagaaagaacatttccttgagatagctggatgagttgacagagatacaggaaatgtcaagaatctaaagacgattcatttctatgtgggcatgagaatttctgaaataatgagctgtagttgacgaaaagcaagcagagcttagtgaataatcttttcaggaagaaagaaggtgaccaggccaaaatgtatcacctctgcagggtgataaatagccactgaatggagaggaaagagtgaaggaggaacaggcaatattaaagtaagttgctggtaagtttttaaaaaatcagtttgatattgttgaatcattaatcatcagttatcctaaaaacaagatttattataatgacttatcctgtgtagaaaaatacatctattttgagtgggagactttcaagatcatttctagtccagaagaaaagaaaaggcaaacattttatttgggcaagtgtcattagagttaagcatctagtgagtggaggaggtaagactgactcttgttgtctggagttctttttattatgtatattactttaaatggccattttcaggtgaccatgtagttacctgtattcattcaacacatattttcttggtgctggaaccttatgatataaagatgaacgagacccttttatctcttattaatgagcttatatgtagttcattgatggagacgtacaggtaagtagacatttaaaatgtagtttattgtggcactattcacaatagcaaagacttggaaccaacccaaatgtccatcaatgatagactggattaagaaaatgtggcacatatacaccatggaatactatgcagccatagaaaatgatgaattcatgtcctttgtggggacatggatgaagctggaaaccatcattctcagcaaactaacgcaagaacaaaaaaccaaacactgcatgttctcactcataggtgggaattgaacgatgagaacacttggacacaggaaggggaacatcacacactggggcctgtcatggggtgcggggagagggaagggatagcattaggagatatacctaatgtaaatgacgagttaatgggtgcagcacaccaacatggcacatgtatacatatgtaacaaacctgcacgttgtacacatgtaccctagaacttaaagtataataataaaaaaaaaaaagaaaaaaaaggtagttcaaggaatgccacaaaacaaggtattatgaattcacattgaaagaaatccttaacccagtctttctgacttggaaaaggattcctggaataagtcatgtctaagatgagtccttaattaagggttggagaagaaacaattggtcaagtttggctaaactgtaaataatttctgtggatttgaagatttgaatgggatgggatcaatggtaatagtttgtgcctgataagataagaaagctccctcagattaaaacgggccttgaaagtcattttaaagggtttggactgagtgccaaaggaaatagttaaaaggctttttttatatttatgctttagaaactagcataggcagtagtgtggatgaggataaatgacaggaggccatgagaaaagttaggaatatgttgcagtgaaaaaatgctaatgtcaatggagagaattacacagatttgtggaatattaatgggttggaattacaggaggtgattaattgaatatgttggccaaaagaaagagcacagtaggcaagcacccaggatgtggatttgaagagctgggtggacaataaaatgccttttactgaaatgaggaacaaagaaacaagaaccaagttttctttagggtaatagaagcaatagatgtaataatactaatagttctttctacgtgccaggaattattctaagcattttacagagaacataggcagtttgaataaagaactcatattcttcaccattacgtgaaacagcacaggctatggagatttcagactctagataatttatgattcaattcattgaattctatttactttaatttattggctgctagctgcattctagaggctggtatagaaagttactcagtacagggccctggtcaagtagtctatatacacatacaactaattctaatttgactttcacaaatgatataattgattgggagagaagttctgctatccaaaaatagaggaaaaagagattaatttgaattgaagaagggaggactgaatgatattagaaagatctctcaaggaaggattgatatttaagccttgagtgataaaggattgcacatgagtggaaaattcttattttagcattgcaaatattttcaattagcttacattgttttcttttaaatggtaattattattggatgaagacaatattcccataaaagtaaaaaatatataattgttgttaaaaagtgtttagtacatatttgtggtaaggtaatttttcctctacagtatttcagaatattcagataagtataattaggaatcatatttaaaaattttaaaagattgtagaatataagattggattgttattgctgctttgttttctaagacaaatttttaaaatttggatgttgggattattagatttaatctaatttatgtgggtaagcttggagttaattattaagtagaacttgatttttagccttagaataacaaatgcagaagtgaagaaaacttttaattggatttgttgttaacaaagcatggcataagtatgcctcagccagcctgtgaaagggatgacttaacacaactgttgatgcatttagagtgaaacatctttatcaagttaatataagaagcagtcatgccctacttgaattactcatttataatagctgaacagcagcctgcatgtggactttgaaatcctgggaaaataagatgcctgcatacatccaaatgttgaaagcttttacccttcagcagctggaaaatgttgagctcttttgtcatctactaggtttttggccctcagggagatgtgatcaatttaattactgaccagctttatctattacttttaatgattatagtcgctgaagtaagcctctgcagtttgtagctgaaaagatcatgtttagatattatgttatttaaaatctataaaagttaaacacatggacctagatgtttctactttgctcaggtttatcccatatattgggatcactaaaaatagcaaataatttagatatcataaaaaataatttatccaccttaaatggaatctaaaaggggcacacaatataccccatatattgcagttcttgggtaaattttatatgttatatctatttttgtgcaactgtttgtaactttcctaagatacagacagtggtttattttgaatcagaactacttataaacacacaatgcaactaattatttgtgcttcttatttagcttcttttcactatctttttgatgactggtccaaaggggatttttagaaaatagcatggagtgaagactatactttcagggatcatttctatagtttgttactagagaagtttctctgaacgtgtaaagcaccatttaaagttcatatggagccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacgaagggctaatatccagaatctacaatgaactcaaacaaatttacaagaaaaaaacaaacaaccccatcaaaaagcgggtggacatgaacagacacttctcaaaagaagacatttatgcagccaaaaaatacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaaaacacatgcacacatatgtttattgcggcattattcacaatagcaaagacttggaaccaacccaaatgtccaacaatgatagactggattaagaaaatatggcacatatacatcatggaatactatgcagccataaaaaatgatgatttcatgtcctttgtagggacatggatgaaattggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagagatagcattgggagatatacctaatgctagatgacgagttagtgggtgcagcgcaccagcatggcacatgtatacatatgtaactaacctgcacaatgtgcacatgtaccctaaaacttaaagtataataaaaataaaataaaataaaataaaaataaaaaaagaaaatagcatggagtgatatggcatagctaagacaagatccctgttatatgaaggaagaaatgtgtctgtaacattaaagctgttactctggaattctaattctggatcttaatcttggtgtaaatcacttgagctcaatttgattgtttcttaatctgttaaatggttgcaatgccagatactgaatactgttgtgttgtccattgcataaagacacccttttaaagaggtcaccattcatgttgcaaactaagttaatttgtttattattattgctgttctcacaaattggtgtattatgacagtattctacagatcgaagtaaaaataaggatggcatcatgtggctggtggtggctgtggatgacattgatgatcctatgtttgactagtttctcctttttagttgatgtgttaaaaatatttgttggtattagaaaatgtaagagcttatcttcattgacaaacatttgatcatatatgtagatgcattatgctagtgacatactgagattttacagataaaataagcagtagaaaacagttagggagatatattggaaattaatttaaaaattgtctcttggtactaggtgataaaatgtcctaaaatttcaaaataaaaaagaagttttacatcattaatatgtatgatattttacttatataataactttatatacaggttaatgatacatctataaacagcctaaaggaaaaaagattaatgaaataagtatcttttgaaagaggttaagtaatggattttatgatcagaagggacttgttctaaagttgacagaagaatctaaagtggtcagaaactgtgttcaaataaaagctacagaacatatatgtatgtatgaaaactccttgacttatgatgttacagcttgataaatgctttgtaaatagaaaatattaagtagaaaatgtatttgatacatctaacctattgaacactatagcttagcctggactaccttaaatattctcagaacacttacattggccttcagttgggcaaaatcatctagcaacacagtgcactgtagagtacagattgtttacccttgtgatcactttctgccgctgcccagcatcacaagagagtagcatactgtatatcgctagtccaggaaaagatcaaaatcaaaatttgaagtagaaggccaggcgcaatggctcatccctataatcccagcactttggaggggaggtataaggattgcttgagcccaggaatttgaggccaacctaaacaacatagagagactctgtctctacaaagaataaatttaaaaaaattagctgggcatggtagcatgcccctgtagtcccagctacttgggaggctgagatggaaggagcacttgaactcaggaggtcaaggctgcagtgagctctgtttgcatcactccactccatcctgggcaatacagtgagaccctatctcaaaaaaacaaaaggaagtatagttcctatagtttctattgactgcatatggcttttgcaccatcataaagttgaaaaattttatgctgaaccattgtaagttggggaccatctgtacattatgtaaatattaattctaaaaatgagtttggagtttattcatttgccttttttgttacccttttaattatctatccaaatattacctgtgtacatataatttctgtgccagatcagggcaaggatgtgaagagcatttattgttctagaagctataaatttttaataaactttttttcactggaaataaggataatatctatgtaattaatgatagaaaaatattttggaagtactacatatttatatataggtaggacatatgctagattcttatttctaatattactacaatatgccattttttctaatacataaaatggaaacctggactgaatgtaaatttgaatgaatttttctagtatagttaaatctttctttactctaaaaacaagcaaaaccttatctgtgcatattgtgaatgcatatttatgcaaggatggtaattgctgtggtctgaatgtgtctcctaaaattcctatgttaaaacttaatcaccaatgtgataatattaggaagtgggtcctttatgaggtaattaagtcacaagggttggcccttgtgaatggaattagtgaccttataaaagaggttgaaggaagcactcatctttccttattgtccttctgccacgtgaggacatagctttcaggtctccatcttggaaacagagaccaggacttcaccagatagtaaacctgcaggcatcttgatcttggactccctaggttccagaactgtgagaaataaagttctaatatttatagattacacagtcttgagtattttgtcatagcagcacaaatgaactagaagagtgataaacaccaatttaagtataaatatttgtgtatttatatatatatatatgagggggagggattttttgaagacatctcgtgtactcatgtgaaatacatttctcaacaaattcagaaaatttgagactttagatgctaaaatgtaaaatgaaagtaaggtttttatagggtttatttgcttattgatctgaaattctgatgacaaaacttagtttagatttttctttttttcttatattgaaaccaagtgaaagattttgtttgaaattggctattgtttcattttaggcagccctttttgagatgcgcataggagctctgcattggtttttcactagctgttagaactttgttctttttaatgtcaacctcttaacagcctaaagtattaatccttgtaatcacatttgtaactttatattttggtgaaattaggaaacttgtcagctattttcttattaaaataatgttttttaaataattgttatatgaatcaactaggtctaagggtttgtgtaataagacatcattacttcatattgagtaatatgtaaaatcatgtgctaattcttttcttccttttttctttttacaaaatgaaaatgtcattttactgttctgataaatgcataatgcaaaaattcccatggaaagaaaaatattaagaagtgttagcaatctgaaactatgtgctagtggttagctagtgtttatgttttggtgaacatcgttttagacaattttctatgcaacgttagataaacatagaattgtacacgtatgattttgtacccatacattttcttctgtacctgcctttccactcaacagtgttttaaagccatctttctatgccactaaatacagtttttcttcctcattttaagtgacattgtagcatcctgttgttggctgtcttgaaattaattaatgtcttcttgctgggtaatacattattggtggatatttggatattgggatttttctaattttttaccaatagaaagaagggctgagttttgttatattcatctttttgagcttgcctgacagtaactttattaaaggcatgttttggtgcattattttgcccttgataaacattgtcaaaagtttattcttcaaatattagtgctaaataagtttaactacaaattttatgatgcagtggctaacttttcagagagttccagtgagtctttcttgtctatatcataattaatatacttttgtcggccgggtgcggtggcttgcgcctgtaatcccagcactttgcgaggccgaggtgggtggatcatctgaggtcaggagttcgagaccagcctgaccaatatggagaaaccccgtctctactaaaaacacaaaattaactgggtgtggtagcacatgcctgtaatcccagctacttaggaaggctgaggcaggagaatcacttgaacctgggaggcagaggttccggtgagccgagatggtgtcactgcactccagcctgggcaacaagagtgaaacttggtctcaaaataaataaattaattaattaaataaaataaaaataaaaaagatatacttttgtctgatagaaagattatcttggagatcgtcaagatgtcatataaataattcactcaatgacatgtaagtattttttcctagaaggttttaatgctttaattctactctcaagtatcttgtaaatcatttctttagtttcattatcccaacactgtttaagagaaagaggttagactttggagtcaggcaaacctgttttcagatacctatttgctttaactttcttcatgactttgggagttaattgtcttcccaagtgttattttttcatttgtaaaatttatttaaaaaattggcccccttacagggattgtttttaggattaaaggtagggaatatgaagagctagcacaaggccaaggagtgagtggcaggtgctcagaaagcagcacctctgctttgcagggatggtttttgatggtcagaaacactcttagagttagatgtgatctggagtttcagtcctgccacattccaaagagcgatcttggccaagttattccaccacttttttttttttttttttttttttttgagacagagtttcactcttgttgcccaggctggagtgcaatggcactatcttggctcactgcaacctcagcctcctgggttcaagcgattctcctgcctcagcctcctgagtagctgggattacaggcccccaccactacacccggctaattttttgtatttttagtagagacggggtttcaccatgttggccagtctggtcttgaactccttacctcaggtaatccactgcctcaggctcccaaagtgctggaattacaggtgtgagccactgtacccggccaagttattccaccgctttacgttttaatttcttcattaaaaagaatcagcacttaagttttgtaaggcttaagttaaattatgcacataaagtatgtagtgcagttttttggcaaatatttcttgtgttactactgatatcatttttaccagcagattaactccacatttaacatgaatttatattttagtttttttattgttgcaccatgctaaacttacagattttttttttttcctgtccatccttacattttaaaagtaaatttggccaggcacggtggctcatgcctgtaatcccagcactttgggagtctgaggcgggcagatcatgaggtcaggagttcgagaccagcttggccaacatggtgaaacccagtctctactaaaaatacaaaaattagctgagcgtggtggtgggcctctgtaattccagctacttgggaggctgaggcaggagaattgtttgaacctgggaggtggaggttgcagtgagccgtgatcgtgccattgctctccagccttagtgacagggcgaaactccatctcaacaacaaaaacaacaacaaagtaaatttatacttaacataaactgagtagcttgccttgttgtgttttgttatatgatcatataactactacctgattgtctaatgggaacatgtgccaaaagttctgtttacaagatcaaaccagtgtgtttctaaatctttgagtctgcctctctctaatcctttcctttgatattcttgcccatagctgtcttatttagacttatttaagcaaacttgtgtgtgtgtttgtgtgtacaccaggggtgagcacaacattttgaggttttcatatgtcctcatttgggaagccatctattgtctgcaatccccaaataccacttgggtcactttatctctgctttttgctatgttaatagcatatttggcattaatgtgcactttgataaacagcaggttacttattctaaataattttatgttagcttttgaaagcaaatagttaaaagaatatatatttctcaataaagcattggttgtaaatactgcaacagtatgcaattgcaacatggtaacattggtatgttgggtgtgttttctttttatatagacttctcaaccagcgagtagtagcttaaagttgttgctgtattccaagtcagtttgtaaccaaccctaatatgtgtttggctaagagtacaggtttccacgtccttacttgtttatccctttcagcctaggtatcatttttgaaggaggttttctgggagatatgatgaatcatcctgcattctcttcccagttccttttctttagttatccattcaagagagattgtctgcattactcttacagagctgggttttagcctcagctatatcatttattaggtgtttgtcattaatgtgctgctgtgtacctcaagtatcccactgtgaaataggaatattaataagtgttagcctacctcatagtgttattgggaaaaaatcagattatttaatatagtttttttttttttttttttggtaaaccaagttctgcacacataataaaaatattaacttttggcccggcatggtggcgtgtgcctgtaatcccagcactttggtgggtggctcgcttgagccccaggaatttgagaccagcttgggcaacatggtgaaaccccatctctacaaaaaaataccaaaattagttgggtgtggtgtgcatgcctgaagtcccagctacttggaaggctgacgtggaaggatcacttgagcctgagaggtcgaggctgcagtgagccatgagcatgcaattgcaccccagtctggataacagagcaagaccttgtttcaaaaaaaaaattttttttaacttttatttagggctcgttagtatcaggcactcttttaagagtcccatcttgttttctttctttctttttttttttttgactgagttttgctcttgttgcgtaggctacagtttaatggcgcaatctcggctcaccgcaacctccaccttccaggttcaagcaattctcctgccttagcctcccgagtagctgggattacaggcatgcaccaccactcccagctaatttatttttagtagagatggggtttctccatgttggtcaggctggtctccaactcctgacctcaggtgatctgcctgcctcggcctcccaaagtgctgggattacaggcgtgagccactgcacccagccaagagtcccatcttgttttatcttcgtagtaacttaatggaacgggagcttattcagtaaaaagttgaaagcagaaattgtagatgatatatcaaaggtatttatgtaagataaggcagaacttagagtccttgtttccatctaaatccaaagacaaattaatggatatacgtttgtgttttatgtttaaataaaatggttttgtttttgttttttaaatacagatggggtctcattatgttgcccaacctggtctcaaactcttgggctcaagagatccgtctgccttggcctccccaaatgctgggataacaggtgtgagccactgcacccaggctaaataaaatgtttagactgtaaatgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttggcttcagatgaacactttagtattttgatgctaaataccagtgataactataaatatttctcaacttatgatgtgtgttttgttttaataaatctactgtaagttggaaatactgtaagttgacaatgcatttaatatgcctaacctactgaacatcagcttggcttagcctaccttaaacattctcagaacacttaccttagcctattattgggcaaaatcttctaacacaaagcctattttatgatacagtattgaatatctcatgcaatttattgaatactctattgatttttttttttattaaagacagagtttcactctgtcacccaggctggagtgcagtggcaagatcttggctcactgcaacctccatctcctaggttcaagcaattctcctgcctcagcctgccaggtggctggcattacagggtatgccaccacacccagctgatttttatattttttgtagagatggggttttgccatgttggccatgctggtcttgaactcctgacctcaggtgatccacctgccttggcctcccaaaatgctgggattacaggcgtgagcctcagtgcctggcctgaatactctattgaaagtaaaaaacagaatggctccatgggcacgtgaagtacggtttctattgaacgcatattgctttagcaccatcctagagtcaaaaaatcctaagttgaaccaacctaagttggggaccatctgtgtaatatgatgaaaatgtctgtctttgttgtttaaaactagtttagaagggccgggtgtggtggctcaccgcctgtaatcccagcactttgggaggccaaggcgggcggatcatgaggtcaggagattgaaaccatcctggctaacacggtgaaaccccttctctactaaaaatacacaaaattagctgggcgtggtagaatgctcctgtaatcccagctacttgggaggctgaggcaggagaatcgcttgaacctgggaggtggaggttgcagtgagccaagattgcgccactgcactcagcctgtctcaaaaaaaaaaaaaaaaaaaaaggaaaacaactagttgagaaggagaactgaaacattgttttgcaaaagtgttgctgtgaacaatgggcgctcatgtcctctatggtgcagattccccttgattcatagagtgctttatctttgtaactagctatattttttctatagtaataccaccattaaaggaattaaagtgacattaagaatgaagaatgttttaaatcttttaaagtcttgtgcattctagattcagtaaaattccagtagtaacaagattttgaagcaactgcagaaactctgcacagccccacgtgtaatgtggctttagaatatgtgtttcttcgcctgtagtctcagctactccagaggctaagacaggagaattgcttgaacctgggaggtggaggctgtagtgagctgagattgcgccactgcactccagcgtgggtgagacagagtgagactccgtctcaaaaaaaaaaaaaaaaaaaaagaatatatgtttctttcttgtgattgtgtgttgctgtggttcagtgattgtgtattgattgtggctcagtgcctggcaaaacatttgtactacagatctctcagtaaggtgatctatttttccatttatatgcatatttatttatgttaccatcagtagttctccatagcttcttttgtagttctccatagcttaattttgacgttcacataatcctgatttcttagagtaatatcatttatgacagattttatagtatagtggttaaaaatatgggctttataagcagactgatttttgtctccactgcatgtgatttttgtgatcatgggctagtttgaatctttggtaactttgttttcttattggtgaaatgggtataattatagtatctgtctcagggttgtcatgaagattaatgaattcatgtaattaaagcatttagaataagatttggcacatcaaaatagtagttattattataatggctcgagtttttggttggaactcaaaaaacaaataagatagtctttgttttctgttttatcagaaagcacttccctatgagaggataatcagggattaggaaagaaaattttaaagaaattcatattttctattggcagatgtgattgctttaaaagaaaatcatgttttgttttttttttcatggaataaggcattgaatccagtggctaaaaggaattgatattgtgtacccagtcttggataatgccagtcaattctgtaaagatgaaatattaaatttgtgctattctgtaacattggtagtcccaacatttttcctggactgtcaatgaatttttgattatctgtgaacattgtctcttggataattcatgagcacattagacccagcacttccaggttaattttgccattttactccaagcctacaccttgacctttattctctgtacaatgaatggtagtattatcagtcaatccattcataatcctagggatcatcctaaacgtttctgttctctcattttccatcttttatatctgggcaatcaacaaattctgagacttttctataaaccttctctgtaagacagatgtgatctttttgctccctttcaaaatatgttttactgcccccctcccaatgttttctgtataaagttcagacttcttagcaggacaacatgagcctcatattgtgtggtattttcatgtgcatatcatcctcccatcatgtggaacgatttgcaattccatgaaaatgccattctcttaccattttcattagtgtaaacaatttttagtgcatagaaagctccctaattttcttcttctcttactttattatctccattttattcaactcaatcattacctcattgaaaatttatttacaaattcgcttcccaagacaggttaggtgtccattgtattttgcttctcctttacattctgtaacttcatatgaatacagttggctctttgtatcaatgcattccacatttgtgggttcaaccaatggtggatcaaaaatgttcaggaaaaaacaaccaataaaaataataactagtaaaaataatacaaataaaaaccaatacagtataataactgtttacatgacatttacattgtactaggtattataaaacccagagattatttcaagtatatgggaggatgtgtgtaggttatatgcaaatgcaacaccattttttataagggatttgagtatcagcagattttgatatccactggggctgctagacccaatcccccagatactgagggattactgtgtctttattaaagcacttatcaaacaatatgatcattagttttttatcagtgtctcccactaaattatgaacagttcaaatacagggcctatttatctctaagtgcttaatgtttacttttaggcatatggttggtgttgagtaaaagtgttttgaattagtaaaagattttgaactaaaaatctttggtaaaagttacatgataaacctgtctttaatgggagatgatgggaattaattgctaatagctattatcaagaggcaaaaataaagaaatggactgacatccaggcttttacccgtttgacattagccactctgctagtttcttcctcttactggtttatcactttggtgttaactatttggtcttgtctgctttcttgttagtactaatcaactctgtcaaaaattgcctgtttctcacttaacctagttatatcaccactgtatttttaatactttttgttaatgctgtttatttttatcagatgactattaagacaaaagttttcgcttatgtttggcgcattggttgtaataaatgtgaagtggattctttaagtcaatttaagggcatctggcaactaggaagactaatccttggagtgaattaagggcatgaagacaaggacctgtcatttataggataagaggtcagtgaactatgtgggcaggataaatatatcaattagggagtttccctgagagtgggcaagaggctaagaatctgagtcaataggtcaggaatatgtagacagtaggtaaaagacatatctagagtgccagatggactagtgaggtagaggttatatgttttcattatattttaggggtatttgactattaagtgagaaaataatgctgtttgggggaagctggccttggaaaatagtgcattcccattagaagttgatagaatatatacgtagtggaacatcttggtcctggtagtgggatactaattatgtttattgtattaaccctatttgattcaggattgtttttgcctacaaataacttagttcaaactaggtcttaacaaaatgcaagagactaatgttcatatttatttagtgaataaattggagtagttttctgtgctattggtggaacaaattaaactttcactggttgagggcttacacctacacagtatagtgtgggaggatcatcagccagtttgtcttattgttttattggcagcagaaaactcttaaactgtgttttcccatggaagaggcatctcacttgaaatctcagaacttatactaaaaaatttatgaagtgggatgatagtgaattacagaagagtcatcaaagaaagtatgtgattaactgacagtttattgacttcatcctcagggccaatttaaagaaaagtgaggcagagttagatttcaagctatgctttgaatgctgtgtgaggtctttttgagctttttggttaagctgtaattaattaactcgattaaacaagtattactacatgaataaaagtacacacacggatttttcaaagaggtaataatgggttcactgctgataaaactgtggatctgagtttggttaacattaaagagcactccaaaattcacctgttgttttaatctcttgatagagaatggtaataattagggttctatatatgtattctatatcttttaatatatgtctatctctgtatgtttgtatatatttatttgacttcagagaaaatagcattaaggtttccttttccttttcaattatattttaaaatgttaacttttaagttagcttgaccctttgaaaaattgttaaaaattactgtcctcaggctttacaacttgtacagttatataatttcactcacagatatgaaagcaaagaaatattttaaagtcttctattttcaaatgcttcctaagaaagatgcttccagtttatgaacaataaaatgaaacttcataggtagaacattttttttaattcctgaatattgagatactgagtcccttttggtttgttccctaaatataatttcatttagttatttttgttaattctgaaagcagcaacagtatatgctatttcactggttattttcatatctgattttgtttatttgggtcttatctcttttttgattattacaagcaaccgaccatcgattttgtttatctgttaaaaaccttttccttttgttgatccctttttcattgaagtttctatttcatttagttctgctctgacttttattatttcatgtcatctcctaattttgggtttggtttgttcttgcttttctaattccttgaggtacaacattagatatttgaaatctttctacttttttgatgtagatatttattgctgcaaatttcctaactagcactgcttttgctgtattccctaggttttggtatgttgtgttttcattttcatttgtttcaagaaactttctaatttcctccttaatttcttcattgacccaatggtcattcaggagcattttgtttaatttctgtatacttgcacagtttccaaagtttctgttattgatttctagttttatcccattgtggcctgagaagatacttgatataattttgattttttaaaatttcgtttagactttttttttgttttattttttatttttaattttttttttaattacacttcaagttttagggaacatgtgcacaacgtgcaggttagttacatatgtatacatgcaccacgtcggtgtgctgcacccattaactcgtcatttacattaggtatatctcctaatgctatctctcccctctcccccaaccccatgacaggccctagtatgtgatgttccccttcctgtgtccaagtgttctcattgttcaattcccacctatgagtgagaacatgcggtgtttggttttttgtccttgcgatagtttgctgcgaatgatggtttccagcttcatccatgtccctacaaaggacatgaactcatccttttttatggctgcataggattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtgtatccccagtaatgggatggctgggtcaaatggtaatttctagttctagatccctgaggaatcgccacactgtcttccacaatggttgaactagtttacagtgccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtctgtgggctgcatacgtgtcttcttttgagaagtgtctgttcatatccttcacccacattttgatggagttgtttgtttttttcttgtaaatttgtttgaattcattgtagattctggatattagccctttgtcagatgagtagattgcaaaaattttctcccattctgtaggttgcctgtttactctgatggtagtttcttttgctgtgcagaagctctttagtttagttagatcccatttgtcaattttggcttttgttgccattgcttttggagttttagatatgaagtcattgcccatgcctgtgtcctgaatggtattgcttaggttttcttctagggtttttatggttttaggtctaacatgtaagtctttaatccatcgtgaattaatttttgtataaggtgtaaggaagggatccagtttcagctttctacatatggctagccagttttcccaccaccatttattaaatagggaatcctttccccattgcttgttttcatcaggtttgtcaaagatcatatggttgtagatgtgtggtattatttctgagggctctgttctgttccattggtctatatctctgttttggtaccagtaccatgttgttttggttactatagccttctagtatagtttgtagtcacatagtgtgatgcctccagctttgttctttttgccaaggaccgtcttggcaatgcgggcccttttttggtaccatatgaactttaaagtagttttttccaattctatggagaaagtcatccgtagcttgatgggggtggcattgaatctataaattaccgtggccagtatggccattttcatgatattgattcttcctatccatgaacatggaaagttcttccatttgtttgtgtcatcttttattttgttgagcagtggtttgtagttctccttgaagagatccttcacatccgttgtaagatggattcctaggtattttattctctttgaagaaattgtgagtgggagttcactcatgatttggctctctgtttgtctgttattggtgtataagaatgcttgtgatttttgtacattcattttgtatcctgagactttgctgaagttgcttatcagcttaaggagattttgggctgagacgatggggttttctaaatatacaatcatgtcatctgaaaacagggacagtttgacttcctcttttcctaattgaataccctttatttctttctcctgcctgattgccctggccagaacttccaacactatgttgaataggagtggtgagagagggcatccctgtcttgtgccggttttcaaagggaatgcttccagtttttgcccattcagtatgatattggctgtgcatttgtcataaatagctgttattattttgagatacgtcccatcaataccgaatttactgagaattttttttaagcatgaatgcctattgaattttgttaaaggccttttctgcatctattgagataatcatgtggtttttgtctttggttctgtttatatactggattatgtttattgatttgcgtatgttgaaccagccttgcatcccagggatgaagcccacttgatcatggtgtataagctttttgatgtgttgctggattcggtttgccagtattttattgaggatttttgcatcagtgttcatcagggatattggtctaaaattctctttttttgttgtgtctattccagtctttggtatcaggatgatgctggcctcataaaatgagttagggaggattccctctttttctattgattggaatagtttcagaaggaatggtaccagctcctccttgtacctctggtagaatttggctgtgaatccatttggttggtaggctattaattattgcctcaatttcagaacctgttattggtctattcagggcttcaacttcttcctgttttagtctttggagggtgtatgtgttgaggaatttatccatttcttctagattttctaatttatttgcgtagaggtgtttataatattctctgatggtagtttgtatttctgtgggatcggtggtgatatcccctttatcattttttattgtgtctatttgattcttctctcttttcttctttattagtcttgctttggtctatcaattttgttgatcttttcaaaaaaccaggtcctggattcgttgattttttgaagggtgttttgtgtctctatttccttcagttctgctctgattttagttatttcttgccttctggtagctcttgaatgtgtttgctcttgcttctctagttcttttaattgtgatgttacagtgttgattttagatctttcctgctttctcttgtgggcatttagtgctataaatttccctctacacactgcttcagatgtgtcccagagattctggtatgttgtgtcttttttctcattggtttcaaagaacatctttatttctgccttcatttcgttatatacccagtagtcattcaggagcaggttgttcagtttccatgtagttgagtggttctgagtgagtttctttatcccgagttctagtttgattgcactttggtctgagagacagtttgttataatttctgttcttttacatttgctgaggagtgctttacttccaactatgtggtcaattttggaataagtgtgctgtggtgctgagaagaatgtatattctgttgatttggggtagagagttctgtagatgtctattaagtccacttggtgcagagctgagttctggtcctggatatccttgttaactttctgtctcattgatctgtctaatgttgatagtggggtgttatagtctcccattattatagtgtgggagtctaagtctctttgtaggtctctaaggacttgctttatgaatctgtgtgctcctgtattgggtgcatatatgattagggtagtttgctcttcttgttgaattgatccctttaccattatgtaatggccttctttgtctcgattttgatctttgttggtttaaagtctgttttatcacaggctaggatttcaacccctgcctttttttattgtctgtttgcttggtagatcttcctccatccctttattttgagcctatgtgggtctctgcatgtgagatgggtctcctgaatacagcacactgatgggacttgactgtccaatttgccagtgtgtgtcttttaattggaacatttagcccatttacatttaaggttaatattgttatgtgtgaatttgatcctgtcattatgatgttagctggttattttgctcgttagttgatgcagtttcttcctagcctcgatggtctttacaatttggcatgtttttccagtggctgctaccagttgttcctttccatgtttattgcttccttcaggagctcttttagggcaggcctggtggtgacaaaatctctcagcatttgcttgtctgtaaagtgttttatttctccttcacttatcaagcttagtttggctgaatatgaaattctgggttgaaaattattttctttaagaatgttgaatattggcccccactctcttctggcttgtagaatttctgccaagagatcagctgttggtccgatgggcttccctttgtgggtaaccggacctttctctctggctgcccttaacattttttccttcatttcaactttggtgaatctgacaattatgtgtcttggagttgctcctcttgaggagtatctttgtggcgttctctgtatttcctgaatttgaatgttggcctgccttgctaggttggggaagttctccggataatatcttgcagattgttttctgacttggttccattctccccgtcactttcaagtacaccaatcagacatagatttggtcttttcacatagtcccatatttcttggaggctttgttcatttctttttactcttttttctgtaaacttctcttctcgcttcatttcattcatttgatcttcaatccctgatgccctttcttccagttgatcgaatcggctaaggaaggttgtgcatttgtcacgtagttctcgtgccatgtttgtcagctccatcaggtcatttaaggacttctctgcattggttattctagttagccattcatctaatcttttttcaaggttttcagcttctttgagatgggttcgaacttccttctttagctcggagaagtttgatcgtctgaagccttcttctctcaactcgtcaaagtcgttctccatccagctttgttccattgctggtgaggagctgcgttcctttggagggggagaagcgctctgatttttagaattttcagcttttctggtctgttttttctgcatctttgtggttttatctacctttggtctttgatgatggtgatgtacatatggggttttggtgtggatgtcctttctgtttgttagttttcctgctaacagtcaggaccttcagctgcaggtctattggagttttctggaggtccactccagaccctgtttgcctgggtatcagcagcggaggctgcagaacagcaaatgttgctgaaccacaaatgttgctgcctgatcgttcctctggaagcttcgtctcagaggggtagccggccctgtgaggtgtcagtctgcccttactggagggtgcctcccagttagggtactcaggggtcatggacccacttgagggggcagtctgtccattctcagatttcaaactctgtgctgggagaaccactactcacttcaaacctgtcagacagggatatttaagtctgcagaggtttctgctgccttctgtttgcctatgccctgtccccagaggtggagtctacagagtcacgcaggcttccttgaactttggtgggctccacccagttcaagcttcctggccgctttgtttacctactcatgcctcagcaatggtgggtgcccctcccccacccttgctgccatcttgcagatggatttcagactgctgtgctagcaatgagtgaggcttcgtgggcttgggaccctccaagccaggcacgggatataatctccttgtgtgccatttgctaagaccgttggaaaagtgtagtagtagggtgggagtgtcctgattttccaggtgccgtctgtcacatgttcctttgggtaggaaagggaattccctgaccctttgcgcttccctggtgaggcgatgccttgccctgctttggctcatgctcgttgggctgcacccactgtcctgcccccactgtccaacaagccccagtgagatgaacccggtacctcagttggaaatgcagaaatcacccgtcttctgcgtcgctcatgctgggagctgtagactggagctgttcctattcggccatcttggaaccacccccgagacttgttttgtgtcataacatgtgatctaccttggagaatgttccatgtgctgatgagaagaatgtatattctgtagctattgaatgaaatgttctgtaaatgtttgtaaggtccatttagtctaaagtacagcttaaatctggttatttcattgttaattttctgtctagatgatttgtctcatgctgagagtagggtattgaagtccccaactattattatattggagtgattgtcctcctacctcagcctctcaagtagctgggactacaggtgtgcatcactgtgcctggctaattttaaaattttttctagaggtggagtcttgctgttttgtccaggctggtgtgaaactcctggcctcatgcaatcctcctgccttggcctccgtaagtactgggattatgagcgagaaccactacagccagcttatctcccattttagagctaatgatatttgctttatatatctgggtgcttggtgttgggtgcatatatgtttagaattgttaaataatgtatcctcttgctgaactgatccccttattattatattatgaccttctttgtgtctttttactggttttgacttgaagtcttttttatctaatataagtatagctgttcctgctcttttcttgtttcaatttgcatggaatatctttttccatctttatgtgtctttacaggtgagatgagtttcttgtcggcagcatatagttagatcatgtttttttataatccatttagccagtccatattttttaagtgactgtttacattcaaggtttttaaaaatttatttttttgttttttgatggaatctctggcatcctgaatctggatatctaaatctcttgctaaacttcagaagttttcagctactatttcattaaatagctttattccttttgctttctctttccctctgggacactgaaaatgcaaatatctggttgcttgatgatggcctctgtgtcatgcaggctttgttaattgttttaaattctctctctctttttttttttttaactaactgggttatttcaaaagacctatcttcatgtgctggatttttttcttgtgcttcatttagtctattattgactctttcaagtatatttttaattttattcagcagattttttatttccagaatttccatttggttcttttgtttatcctttggtaaatgtctcattcaaatcttggtgttttttttttaaatttctttgcatcatttatgtgtgttctcttatatctcaatgagcttctttataatcaatattctgaattatttccccaggattttgtaaatttctttttttttttttgagacggagtcttgctctgttgcccaggctggagtgcagtggtgtgatctctgttagctgcaagctccgcctcccgggttcatgccattctcctgcctcagcctcccgagtagctaggactacgggcgcctgccaccgcgcccggttaatttttttgtattggaatttgttgcttgagaattattgtgttctttgggaggtgtcatatttctttgccttttgtatgtgtgtttcttttgttcttatgttgatatctgcccattggtagaacttttgctccttccagttttttgaatttgtttgcataggggaaggcttttacctgaagatgtatctgtcatcttggttgggttagggaactttggtgttgattctgggtgcattatatggtggttttctggtgggatgcataggttgggctagctgtggccctggtgctctggaaggcagggttgctttcagtgtcagtggtgtaggcttgcaactggagaatgcctgctttggccccaggtgttggatgtgagtggggtagcctgtccttagggtgcttataaatgcacagttgctttgctacttggagtggcagggccactggcaatggcttttgctttgggcctaatggtggcaaccagccttagtggcagcggagggcagggaatgtcagtgggaatatagggatatggagatgtaggggctttttggccccaggttatgatgcaatctggtaggacctggattctcaaagtggtgctatgctgtagttgcttaggcctcagggcgtttgggacatggcataagcgccctctctgcagcaatgccattacatggtttcccagcacctccctatgttagtttcaggggcctgtgagggtcaaggttctctctcttcactagaattacagggatctgtgggggaaatgtggactgctggaagtttctcactgaccctttctcctcattgggatgcctctccagggtcgcagccggtcccagtcaagcatgctccctcacttctttttccttcctttcttgtgttttttctcactcttgttgaattccattgttctttcttagaggatctatttgaagagtgattatttactcactaggttcttctgtgtgaaggggatgagtaccagatgcctctagtcagccattgtgaagcccctgtcttgtggctttatttcttatttcctgttataccagtagctttgatgtgccatctttatgcaacaattttctaatgcacacaatttttggaatctttttttctgttttagtgatatatgaaataatgtcgaatcttgatattatgaaatacagaaacaaatgttcttactaaaagggaatgcatgtcagctataagaaatggtgtatggccttggggctgcttcacaggtggcatagaatggcctttgtaggaacatcttttgtggctcaaagttataatgagttcatctactgtattccttgctctgtttataagcaaaacctctttgaggttatcccagatctggcaagccaacatagtttcatatcttgcatgattatttagtgagtgggtatggatctgaactttagataaagtttttttttaaattatttgtacttatttatggggtacagtgtgatgtttcaatacatgtatacattgtgtaatgattaaatcagggtaattagcatatccatcacctcaaacacttgtcatttctttgtgatgacaacattgaaaatcttctcttctagctgttttgaagtatgcatacaaatcacaaggaatttataataatactatgcaattacagaatatagtctaataatgttactatttccaccattttaggttttcatatacatttgtgtgtctgtgcatgtgtgtgtagacataaaattcattttattttttaataaattatatgttaactgaaatcctctgggtaaccattccttcttctcagtcctcccttaatttgaagtgataacttctaaaaattcactatgctgtatggatgtgtatgtggatttaccttggtgtaataaaaatatcttgaataataataataaaaaaggcctagagaacctgaaccattcagttattatttgaacaatgggacttctctttgaattgagaggtactgaaggacttgttcatcattaatgaggatatgtaacaccatgtgaattactcaattcactgttttaaaaagttttgtcatgaatgtaggtgcatgcactaaggtactataaaatcacaagctaataggggatatctgttttatatatgtatatatatgtgtctgtgtgtgtttattccaactgtgtttttttggggggttaggaacattacggagcctttagaaagctttactttactgttaacatttaaaactttgacagtagttttcaaactcagatattaagtttatgccattgtgttcttgccctaatttactgcctttgcaaattaagcattctttttgaattttcctattggatggggtaatatttgagtgtatataaacaaccaaaagactattttgagtagcaagcattcataaaatggttgatgtgcttattcagttcatgagcatactgatattgaataacaatgctgtgcaattattctataaacaaatattcattgaatacttattgggtaatatggtatgtaaaagagagagattgatgaataaattccagtgataaaaatatagcctctttatggtacttccagtttatctattcctgtcctgtatggtagatctcattttaagacaaagaaaagaataaacaaatttaaattatggagtaaggaacttcaatataagaaaatatcctgtcattgagagtaacttacatggaattattattttttttatttttgggatggagtctcgctctgttacccaggctagagtgcagtggcatgatctcagttcactgcaacctccacctcctgggttcaagcgattctcctgcctcagcctcctgaatagctgggactacaggcacgcaccaccaagcctagcagctaatttttgtatttttattagagacggggtttcaccatgatggccaggctggtcttaaacttctgacctcgtgatccacctgcctcagcctcccaaagtgctgggattacaggtgtgagccaccacacccgccctacatgaatttctttatgagagaagggtcttattactgagattgttcaggtgtgttattttaaggccaaagaaagtctagttattgttaaaattaggggcataatgatgtaatgtagtagctctcaaccctatcaaatctaatgcccctttttgtaacatgtattttcttatgtccctttactatcttgaaataaaattcataattgtactttcctaagcttatgatttatgaataaatctatataatataatcttattaagggagaaataaaaggaaagtaatttataatagaagcacacatttttatatttagagcataactagatttgaagacatgatgaggtgttcaggtaagatactcagcctgccacatgtattgtaccgggacagttacaagtcttgcctgtgtatatgtgttgcatattggcaatgaatatcctcaaatgaaatagccgtgagtgatgtgattttctaaaatggtaaacatgtctttgtcaaatgcgaaatgatataaaattttctcctatattgctgagagatagatttctggagctttctgggtctattaaaagtgggtgaaaactgctttgtatttagatgtaaaattgagttagagtctaaattcaagtaattatctacaggtttttaacttacatggaaatctgcgagaatatttcaaaattgttcaggatgtacgactgttctttgttgtaaaaggattgttttggacattgaacaacttcattattcttggttgatggttaatgtcagtactgtctcctaatcattgtgacaaccagaaacactaatttttaaaaaatgcccccagagtgtggtgcaactttcatatagaattgactgtctgtagaacaaagagaaagtctacaggcaagagtcacagccttggatttgattcttgtttcttctacttaccgccttcttactgaggttttgatattggacaagataatcgaccttttacagtcttagtttcctgtctggaaaactgggatgataatatctcacagagttgttttatggattaaataatataacgtattttaggtacctgacatgtgcttcatgtgggatgggactatatctcttttatgcaccactttttcatcactagtagacacttaataaatacgtgcttactcttgttatttaactcctatatgtcacactctgttccaatattaaaagcatgagagggagtgattgtttataataggcaccatgtctatcatctgtgtctttcctttcaatgttttagaacttgtgaatcttagatgagaatgcttgttctttggaattgtggccttcagtttctaagaccttattaaatagaaatatgatggtttgctttacatttgaaagggatttatgggataaaggtccgccttaataagcacactaatttcccagcatcctgatattttttcttatttatttatattgttttgctaatgtcaggatggatagtgggggctatgtaaaagaccaaggacctcccttctcctgggaatcctaatctttgttacactaatgtttaaaatacaacatcagtaatttcttcctcttcttcaattttctttttactcttcctgtgattttggccaattaatgttgatatattttgttttcttagtaaatatttgctatctttgttgtgttacttgtttaactttaatcttagatgattcaaaccatttactaatgtaagatagaatagttacttttggcaattttaatgcaacttattactttgaaaatgttagaagggacccctagttttcctttgtaaattgtcgtttatttggcagagaaagcatttaatctgtaaatgctgctctgtgttttatagaatggtgaaccttacaagtattttatcccaaatagatgtttattaaaattttaacttaaatatttgatgattattatgaataagagtttttaaagcagtcactttgctttgatattcacagtgtgaacaagctaaaattttctacctactttctcttctttttattcttccaggtcacctttgtgtcaggcattgctactttggcaaacctgcttgcctttgacctttggttactcagttttagtttggttttgagccagtgtgtgctgaaatctttaaaactaaacaaatatttagcattcatttgatttaccaacaattgtctttttaaatattcagtcactccacaagaaaagtaactattgtcagttacagactgtagtaccaaagtcagattctggaacattctataaattactaaaaaactatcaggttataatttagattggctcagatgattttaggttgttttagaagctgacggtatttttactcacaattttctttcttttttctttttcttttttttttttttttttgagacagagtcttgctctgtcgcccaggctggagtgcagtggcgtgatttcagctcctgcagcctccgcctcccaggctcaagttattctcctgcctcagtctcctgagcagccaggattactggtggcaccaccacgcccagctaatttttgtatttttgtagagacggggtttcactgtgttggccaggctggtctcgacctcctgaccttaagtgattcacctgcctcagcctcccaaagtgttgggattacaggcatgagccgtcgtgcctggcctattccaaattttcgaatgtgcgtaaataattaatatagatgactatattagataagggacatgatatttttcctaataaaagtttaaaccatatttttatccattctctggtaattatttcttaaaaatgtaagtacatcagagaaatgatttattcatttccaaggctgagaaggtgaattttaaatttgtatttgaataacatttgtaattttactttacttgcacataacattatttttgcttagtaagcttatgaatcatttaattcctactatatgagaaatgtgttatgggatattgagaacattatgatttaaacgtaatacatatttagttgtcttcaatctcatttctatctctttggaaattaaaaggttccaaaactaagactgtgggaatgaaagtgagacttttgttttcttttagttgtatcaaaatgtaaattcctgggaaggctatttttgccttttgtgtcacaattattatgggaagccaaacaagctgctattaggtgttagagaatacaataaaattagacccttatttgctcactggccaaagaccacgtgttcctttagttgtatccttcagacgagcaaccttgttgtttgtgcccttgcttttgccttttcctttgtgtaattttgttcttttcctagagccatttgtaattgactgctgtttactaatagtttagagcaaaatagccacctttttcatggaacacttcagagccaactgcatcattaaaatgtacaaatgctctatgaaaatgtattcagttagtaagattaggctgaattgctagatttaggctttactagatcactaatattttcacttaattaaggctagtactttttttcctgagtagagattccgtttgttttcaagaactcaagaatatgctgctgctctttatgttgctctggaggcatgaatgtaattttgcacataaaaatattctacaaatctttccttaagagaataagggaggaaaataaaagtacatttttaatttgagggttggtcattagacttattttgcctataagattgacagcgtgactgctctttaaatgttgaattgggagtttaacatgaatgcaatccacatgtctgtgtcagagttttttgtatttttttcctggagatgggaagtataaacatgcaaagacttagctattgcaagaaccttattttggtttcttaccctgttctgttttgtatctgcatttgtaaaggaatttaaggaagttggaatggatgcaaagaaaaggaataatcatcattaggatagaaacaaagacacaaggaaaacaaagtatagttcttaaacacgattgtcttacttccttgataattctttctgatgtgtgttatcttctgcactctgtactaagtcacaaaagatgtacaaataatttttaccagaaaagtatagaacagaatcagaatgtgaattacttgctcaggacatagttatccaacattgtttaataattatcacaagagagccaaatactaggaacgaccgactgagatcttcagcctagagggtggggtagacaggcttggccagttcgtactctttcgttccttttgagcaagggaggaagtacaggtgaatgtgtttaatagatacgtgttcactgatgtatacacaacaaactttcactttgtttttcctttcatacctatcatgacactcttagctgcatgacggtaattacagagacagagatttcttagtaatcttctcagggagcatagagagttttaaacagtgactcttaggaaagttggtcattttctgtctcaacaaaggatagagggaaggaaactaacaattattgaacaatatttccagatactatggttgatgcttattttcttacatccttaaaaactcagaatagcccagtgaagaaagaactccttcatttttgcattgagaaaacaggcttaggcaatatattgcaatatggcttattaaccatctcaaagacacataactaataagtggcacaacaaggaattgaaccaatatgtttatatccccaaagctctctattatatcatgccatctcaaatcaagtgtctaaataattggaaatggaagtaatagagagtttagttaagtacaacttagataggctattatctaagcacaattaaaacttagataggctaccaagtacacttgaaaacatagtgctgtattcctcttccccaataaggttgttgttctaaataattagcttgcattttgattaatcttgattgtgctctgatacaaaatattgcaattatttgacttgcaacctgctttatagagttagtgatttattgaatatcttggaagcaagtccttgacaggcagtattttaaggtgaaattgctatgtgaggattttgttaacctgacgttttgtggtttcgcctcataaaactggcaaaggactcccagcgtggaatgttaatggggtgaagtaatgaatgcaggctgagttacaagcatccagatatgagcaatcctatagttcatactccatgattcttgcgggaggtctttgtagacagaagctttactaaaagataaaagcagtaggagatcgttaaaactcagcagttgatcaaactctttctgaaacctaggcttagaagccaagcagagatatgaacatgggaaagtaattaatctattatagtctttcatgataattttcactttctcaaactgttgaagtaaataattgttgggtacctatttactctaaccaaatattaacctttttattcttttcagcttttaagtactgcccattccacttctatattttgatccctcaatcagatagctaatttaattccagcattagttatgcagattttattccactggaccaaagcaatatactgtgttcctcttcccatttaattttattttaaaactttgcttgcagagctgaaagatttcttagagttttcatggggctggggttctggctgcttgcttctagattgtatcaaagcagctctgccttttttctgatttatttgttggactactccatgagattttgtctgaaaaaaagaaaaaatgtcctgttcctaagaaagtttgaaagccacatatatagctgtttaatttaaagggtatcaattgtaagatatgttttcaacatttttgttgatcacgtatttcaagtgacagagcacaagggtatagattaccttgaatcttgtattctaaagaaaagaaccaattatttatatattgaggggaattttaggacttgttactataatgtagtcagttttgtagattacatctagttacaaagattatatatggttttaaaaattgttgtattttgatattttatttttaattaaaggctcttccttctccttccattgtataatcatattaaggtatcttttagataaaatctgaaaacacttttcttaatcattctcattttcattgagattctgaacaggtaggctagcattattgttctcaaatggctaatgacatattttaatctatgctttactgcttatacaattagttaaaaggtcttaaaattctttgagattctcttctttaagaaaaaaaatacaaagttccaatatgttgaagaggttgggctcaaactcctgggttcaagcagttctctcacctgggccccccaaagtgttggaattacaggcatgagccactgtgctcggccaagattctcttaaattcatcttttgctttttatttccgcttaccctgctttagactaacttctcaccgtcaatcacagaattggttggatagtttgctttcttgctaattttgccttctttcacttgttctctataaattgtccagactatcagataaaatccaaatgtttcatcctttgcaactgctcatatactgtctaacttagtgaaacaaactgttttcattgttatttgttcttcagaatactacctcctaagtaaatggtacctccctatcaaaggcaattttgtgaaatgtattattcaaagcaaccttagcagtataattcttatctgtgtatatctgtggctcaagccaaaatctcaatcagcttaaatctggcatctcaggggagagttattatttagttcccttaacattattttccatgattggcaaggacctagtcaagatgtttttgttagttcctcttagaaaaaagatcacttttgggatatcagctttcaagtatcaggtaatttcctgtttaggtctttatataaatgcctatcaacccttataatactttttattttatccctttgtatctacattccaaataattaaatcatgcattccttttacggcccttagtatctcaaccaaaataaatttttattctttagatttttgccctgattaaattatttatttgttttccataggatatgttttttgggggtcatttctcaatactcccaaagctgtaccttaatgattggtttacttacatacccttgtaaccagtttattgaaaacaaaaattatttcttactctacagttttccttcttggcaatttcttattgcatttccttctattctgtgcacagaaaaacaataatgtattatagtggaagtattggggagatagtgactcaaataattttctgtgctttgtggtttagatgaggaaccctgcttgaaaaaacaggcatgtgcgacaggtactcagtgtatatattgagtgaataaatttgtgttatttacattttatgtttgatatgtgtatcttatttcccaactatattctaagcttagggagagcttaaacaatgtcctcttctatatgtgaatttgtctaattggtaagtaagtagtttatgaaaaaattaaataatttgaaataaggcagaatttctatctatcatctctaggtagcttttttttttttttttttttttttttttttgagacagaatcttgctctgttgcctagtggcacaatctcagctcactgcaacctctgcctcccaggctctcctgccctgctaatttttgtattttttgtagagatgaggttttgccacgttgctcaagctggtctcaaactggagagctcaagcgatctgcccacctcagcctccgaaagtgctgggattatagacatgaaccaccatgcccagccatccctgcatattaataaatttcatgtatttgttagtctcctacaaatatatcatttatcacaatttattttatcaattttgagatacttttttcatactttaacttttctgaaaataaatggcctcttactactggcctcagttgaagttcagctctgatagagggagtttgtgtttgcctctggcattcaatctcagacacatgagaccactttgaattaagttgttagatgatttttggatttcactgatagtgtgaatttagactgccataattgttaatactgggttttggtttcaattttatgagatttcttcccctaccctccacctagtacaaagattcgtttatgagtttcttcctatttctgtctacttcgaagagtttttttctttaatcttaaacaaaggtgtaccccttgggtcttccaattctatgtacatgtaaaataattgtgtgtcatgattgatggtgtcttagataagaagaaatacagaattgcagtcaacctaattgggtagaatggcaactgcaggaaattgagtcatcccaattcaatttaaattttgaagtttaccaatgactaaccaaatattattaaagaacagtgattttatttgggatttcactttcaaaatggaatttacattaatgtagtatttagatttaatgtattaataattaatataggtagccagtcaaataaatggcagctagccagtcaaataaatacaaaaatttgcatcagagcacagtcaagattaatcagacacaaggtagaagcatggggagacagatagagcagtcaacacacataagatattatacaggtgggagggaaagagcacatggggttaattaaaacacaagttacaggcaagagactagagatagggcagtcaacacacttcggatactgtataagtggatgggaaagaccacactatctgaatctggtggcatggaatgtttatgtatcccctgcccactttacagatgactaacttaccctctatgtttataacacattttatgatctctactgtttcataagctactttggttactcacaatttgtatgatttctatctgtatctcataagatgctagtttacttactatctatggttaacatttcttatgagtcttattcatcctgtttttcttgatttataatgtaacagaatattctcaaacaatacacaaaatataccttacaaaaattctctatcagtcaaggtttaattagagaagcagaaccactaggagatatacttttaaagtagaagtccccgatctgttggccataggccaaaatggttccatggtctattaggaaccaggctgcatagcaggttagtggtgggttagtgatcattactgcgtgtacaccatctcatgtcagatcagctgcaacattagattctcctaggagtgcaaaccccattgtgaactgtgcatgcaagggatctaggctgcacgctcctcatgagaatctaatgtctgatgatctgaggtggaacagtttcatcctgaaacaatcgccatccctgaaccaagtccgtggtaaaattgtcttccacaaaacctgtccctggtaccaaatggttcaggagtgctgatagaaaggatttattataaagatttctccatactcaattgtgggagttttaaaaaaattctgtgggaactattacttttgtgtttggtgctatcacctgaggtcagcaaggcaggaagttgagctgggaaaacagatatgaagtaggggaagcaaggacaaatggcaacctgaaaggtttagtgggacctggatactctctgtttccaactttggtgatataggtgtcttgtaggagaagatagctaaattttaaacctgagatgattggataagataacttttaacaagtttcaagtatttgcaaggagatagaaaaatcaggaattgatcaagttaagatttttgttactatgttggtctttttataaaatggctattttatgcaaataaagaagcagttaatttttttcagtcagtttgagtgttttaaatcaaaatattctttgatatcttctgaggagatctcaatttgtccagctacatccctgcagtagaagaagagtgtgaattcatacatctgaaaattccagcccaaagcaagcagctacgaaaggaaaatctactttacgtctcttagattaaaaatctttgtaagtttgacattctactccacaatgcattctgtttgttttacctctcctccccctagttattagattaagttgctcatctactaagacctactgtgcttattttttcagttgagtgcttcttagcttaccactatacatgcctatatatgtaagtaccctcttttgaaaagtctagctcatgatgatttctaagattccttccagttgggctctttctggattatagacttctaaagtattcaaaattgtgaactgttatctttccagtttttatgtgaaacatatagagtgaaaatttaattctcttggccttgttttcataggtataaaccctgtattttagtttggggcatattctgaaaaaatgattcatttcaataaaagcagctatagtatattacaatcaatgcttatattcaagcatgtgtttagtaaaatgaaatattattaattttgaaaagatacatttttaaggtattatggaagaacattgtggtctatatattttgttttgacaaaatcaccttagggaatgcagatcataattttatgtctacatttttttgccttgacatccaatgcatgtttttagtaattcaaggaaatccatctgctttaagaggaaaaaccctgttaattccagattataaataaaattgatctttttgagtgtaatttccagtttcgtttttgaagcaacttatttctttctgagccatcagctgtagtggattacattaaacataaccactaagcattctcagtgaactttatctttctgtttttcctacaaatatatttcctctaggattttattaaataatgtcattcttatcatcttgacagattctagtaacagactgcaacatagtgaatctaacagcaaataaaaataaaatagataaatgatagcattcagtattcctttcaagcatggtattttgacaatggcgtgaaggacattttgggccacataattctgtctcatacattgttggatattctgtagtatccctgacctcttcccactagataccagtggcacccttggtttgtttccagacagtgctatatttcctatgggtgatgaagtcacccctgtttgagagtcactgtttagagtatatattttattctgtaatatatattaactcatttgagatgcctatttggagaggcatgtcttccaaggattttagaaaagaatttaaaattgtcttcaaatatttgaacatgttatttggactagttattttggggctactattccagaacacactggactagaattgttttctgttaaagtaccccttattaaaacttttgatcatatatataatattaaaaatagtattatcctcattgctattatattatgccattcatagagaatgaatgatgaggccagtgatgggggtatgttattttaataatatattctatttggaggttgagactttggatgagaaaggggaattcaggaatttaatcaagtactgaataaagaaccagagtcagagaacagaatttcactttctgaaccatcacttaatatagttgtttcttacccctgacctaaagctcatgcattattccttctgttatcttcctgtcttccctcacccctactcctagcccaaattaattgtttcctaagtgttcccccttttcttcctcaattttgtttatctaagcacttacaatctatattttaattttttcttccttctaagttgtgggataatggagtgctgggttgaaaagtggaggattagaagggcgttacagtggtaccactggctacctcaagaagttatttgatctagtcattgtcttcaaccagaacggaaactatcaatatcttgtttcttagtggcttgtagagactctccaagtacccatggtaacttttttttcatatctaaagccattaagcaaaattttatttcttttgttcccccttgtcttaaggcaatttagggttagttttttattgcattagagtattaggtgaagttgagtctcttaaagaaaattccttgtattcctggtaagaattcctccttcacctttcagcttcattctcatatacattaaaatgctttcattcagattctttaatcatagataattttatgaactatccattgaatttcctctgattttttaatattcttttcggaataaggatgcatggttccactaaactcttacttatctggtttgtggcagagaatgagacctatagaagaaaatttaaacttaaatgaacagtgctggcaatttacttgttgtggttgtttttaaataatgcactggtcctacaaagtgcttagaaaaccttacttaagggatcaacctgttcattttaagtagtgttgcttgtcattgcgttactcactagtcatttactacagtagctactacattgacaggtaaatgaccatagaactgtcagcctgtgtagcaacactacttatagactacttctagaatcttgcagtttagagctgtagagcagccaagatccctttataaggaacatttaaatagacttatgttctcattagcataaacaccactagtagttgaactggaatatcaattttaaaattctgaattgctaaaaaactgatactttactagtaaatcaagaaaaaaattaaaatataacctgtaagggccagttggttagttatgttaacaacatatgaaatatgtaggttgcatttgtgcatttttgtacaaatcaatacagtaaacttcttagtacgttttgactttggtgatgttggtttggtgtaggttaaattgtaaaatttaaggttggaaatgaaatctgaaagctgctgcaaaaataatggaatttaatttaaagtattgcatgtttacatgagacagaaggatacattgcatgatcttacagcattttataggtggttgacaagaaattgtatttggagttcaacgttgtaactgcatagggataactttagtaatttaagataaaggaatacttaacacagtacagcataaattctgttttgtttaaggaatttttaaaaaatttatctcaaaatcattttttcagaaatttgagcatctttgtaacaacagtttggctgctccagaaacgtagaatagagctttgtttttatttattgtagaaaattgtgaatttaatggggtttcttataacatattgataaatcagacagaaatttggccagtcttatgttctgacatccaaaactatattaggtgaactcagtgtaaagactcattggatcatttaaataatagactgtgacttaggttttttcagtatttgtcttgtggttcataaagaaaatggctaaatagtaaacctgagataattggattaaatgattatttttaacaagtcccaaacatttgcaaggaaatagaaaaatcaggaattaatgttaagatttatagttactatattaatcttttcatatatggccactttatgcaagtaagagaacagttaatttttttttgttcaatcagttcaagtgttttagatcaaataaaatattcttttatatattctgaagaattaattcagtacattctctgagtgtcccaagaggtacagtgtggaaaggatgtttatggtgatttacttgtaaagtaaatgttacccttactctgcatcctcagttcagtgctttacgtacagtcataggctattcttcagaacatccttaaaagcacagtacagaaaacaagatgaaagttttagattaagagactttattcattttcttccagactctccctaataaaatttcttctgaatttcccatatgaattctaaacattttaaatatcaggcttctaataacacttttttgtccatttatttatgttgaaattctactggtattgcattaatctcatgttgataggaaaggataaaaagttggctcacatgtttttttatagcagggtggtcaaatataatagtgttgcttatttttcttaatgatgaaatagtaaaatgattccaaggcctacttagagaagagcttagacttcagacagtgctttatctacatgagggagtaatcataattcttcagacatgtaagtatcagaagtctttttaaataatagtacttagtctatttaaatagtattaggttactggcagctttgtagtgagagtttgaatttttgtagagtttatatattttagacaagaatctgacatttagaaatgtaacattattcttaaattttaaaattgtttttatctgaagggggtcagggacatgtaaaattaatgcccaggaaatctgtttttggagaaagatgtgcatgaaaagtaaaggccacatatatggtgatttttaaactttactttcttttaatgaaacattttcttttgaggtaattatgtagattcacatgcagttgtacaaaataatacggaaggatcctatgtatcttcttctcagttttccttaatgataacatcttacaaaattataatataccaccccaaccaggatactgacattgatacaatacatagatcttgttcagatttcccctgctttactggtattcatttgtgtttgtatgtatttaattatatgtagttttatcacatatgtagattcatgtacctaccaccatagtcaagatacagaatagtttcatgactgtaagaatcccttgtgttacccttttatgtccacatctactttccttctgcttcctcctcaccatccactctaaccccaagtcttaaccactggcatctactaatatctctatgtctccaattttgtcatttcaagaatgttatgtaaatagtcatgtaatatataacctttctgggattggcttttttcactcagaataattctctggatgtatacatgtatgtatcagtgtctagtgttttacacaatgtttttgaaatcgtttgtcttgtgtatatcggtagtttattgttttgaattgctaaatagtattccattgtatggatacagtacagtttacttcttcattctactattgatggacttctgtattgtttctattttgtggttattgtgtttaaacctgctataaaattcttttacaagccttttgtggacatatattgtcatttctattgcatacatatttagaagtggaattgttactataaggtagttgtatgtttaactttataaaaaactactagactttttttccaagtagttatatgacttaaactctcccaccaacaatgtgtgttacaatgagaatgacattgttccattcatatctttgccaatattaggtgtagtcattttatctgttttactaagcttgaaatgatatctcattcttgttttaatttgtgcttctcagtaactaataataataatcttttcatccttttggcatttcagataccttcctttgtgaagtgtcttaaaagacttgaaggtcgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcgtgaagcgttgttgaattttgtcaaaggccttttctgcatctattgagataatcatgtggtttttgtctttggtcctgtttatatgctggattacatttattgatttgcgtatattgaaccagccttgcatcccaggggtgaagcccacttacttgatcatggtggataagctttttgatgtgctgctggattcggtttgccagtattttattgaggatttttgcatcaatgttcatcaaggatattggtctaaaattctcttttttggttgtgtctctgccctgctttggtatcaggatgacactggcctcataaaatgagttagggaggattccctctttttctgttgattggaatagtttcagaaggaatggtaccagctccttcttatacctcggtagaattcggctgtaaatccatctggtcctggactctttttggttggtaagctattgattattgccacaatttcagctcctgttattggtctattcagagattcaacttcttcctggtttagtcttgggagggtgcatgtgttgaggaatttatccatttcttctagattttctagtttatttgcgtagaggtgtttgtagtattctctgatgatagtttgtatttctttgggatcggtggtgatatctcctttatcatattttattgcgtctatttgattcttctctcttttcttctttattagtcttgctagcagtctatcgattttgttgatcctatcaaaaaaccagctcctggattcattaatttttgaagggttttttgtgtctctatttccttcagttctgctctgattttagttatttcttgccttctgctagcttttgaatgtgtttgcttttgcttttctagttcttttaattgtgatgttagggtgtcaatttcagatctttcctgctttctcttgtgggcatttagtgctataaatttggccagggcaattaggcaggagaaggaaataaagggtattcaattaggaagagaggaagtcaaattgtccctgtttgcagatgacatgattggatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccactcacaattgcttcaaagagaataaaatacctaggaatccaacttacaagggtcgtgaaggacctcttcaaggagaactacaaaccactgctcaatgaaataaaagaggatacaaacaaatggaaggacattccatgctcatgggtaggaagaatcaatattgtgaaaatggccgtactgcccaaggtaatttatagattcaatgccatccccatcaagctaccaatgactttcttcacagaattggaaaaaactactttaaagttcatatggcaccaaaaaagagcccgcatcgccaagtcaatcctaagccaaagaacaaagcaggaggcatcatgctacctgacttcaaactatactacaaggctacagtaaccaaaacagcaaggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaacactggctagccatatgtaggaagctgaaactggatcccttccttacaccttatacaaaaattaattcaagatggattaaagacttaaacgttagacctaaaaccatgaaaaccctagaagaaaacctaggcattaccattcaggacataggcatgggcaaggacttcatgtctaaaacaccaaaagcaatggcaacaaaagccaaaattgacaaatgggatctaatgaaactaaagagcttctgcacagcaaaagaaactaccatcagagtgcaggcaacctacaaaatgggaaaaaattttcgcaagctactcatctgacaaagggctgatatccagaatctacaatgaactcaaacaaatttacaagaaaaaatcaaataaccccatcaaaaagtgggtgaaggatatgaacagacacttctcaaaagaagacatttatgcagctaaaaaacacatgaaaaaatgctgactatcactggccatcagagaaatgcaaatcaaaaccacaatgagataccatctcacaccagatagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctatagagacacatgcacacgtatgtttattgcggcactattcacaatagcaaagacttggaaccaaccgaaatgtccaacaacgatagactggattaagaaaatgtggcacatatacaccatggaatactatgcagccataaaaaatgatgatttcatgtcctttgtagggacatggatgaaattggaaatcatcattctcagtgaagtatcacaagaacaaaaaaccaaacaccgcatattctcactcataggtgggaattgaacaatgagaacacatggacataggaaggggaacatcacactctggggactgttgtggggtggggggaggggagatggatagctttaggagatatacctaatgctaaatgacgagttaatgggtgcagcacaccagcatggcacatgtatacgtatgtaactaacctgcacattgtgcacatgtaccctaaaacttaaagtataataaaaaagattcctaaggggaaaaaaaaaaagagttgaaggtcttttgcccattttatgttaatggtttgtctttaattgaattgtaagagttccttatatattctgaatacaggtcagctatatgtgtgcataatatattttcttagtcttttctttgttttttctttttcataacaatgttttacaaagaataaaattttaataccttggtaaattcacatttatcaattttttagtgattagtgcttttatgattagtgcttttttggacttctctatgaaatccaggatatccttctatattttcctctaaaagccttatagtttagcttttaattctatgattcaaaaaatcaagttttataaatagttgtgaggtagagatcaagtttttgttttttttttctcattcatccagttattaaagcatcatgtgttgaaaagactttccccattcagtgccctggcatgtttgttgaaaatcaatagacaacatatgcatgattttatttctggaattctattctggttttttaatctgtttgtccatggtcatgccagttaccatggtcttgtttgctggggctatataccaaatctttgaatcaggtaatatgagtcctctaattttgctatttaaaaagattatataaagtactatgtgttttttgttttctttctatattttattatcaactggtcagtttctattaaaaacacctgttagaattttgattgggatttcattgaatttgtagataatcttgaagaacaaaatggacattttgacaatattgagtctttaatccttgaacgtagtgtatctcatcatttttttgggtctttttctcatgaggcttttgtacttatttcttgcgtactacattccattttattctttatataatctgttagggtacccacagaatatttttctataaggatatatttatatttcaaaatttatataattatacttactgagaaaataagatgtgacttctaagaattgacagttttgacggtatgtgattcacatgttaaagcctcttctgagcacattatatttaattttagcttttattttgcctaacatataaaaatggattcaatgttatagttaatgaaaacaatgtcagattattttgttaccttatgttgcttatacatggaagcattattttgaaattcagtgtctctcaatcgtttatatgttgcagaattttattgttttgaagcttagacattcttataatttttattaattaacagaggttgttaccatgataaaattttagtatctttgattaataatgaggtccattacatacaggaagacatgtattctcccactctatctgtggtagatcagtgattatttcttttttattatgaggtatgtcagacatgcaaatagagaataatataatgagtatcacagatcaaaaagaaagtcaattttttaatttcctcatgatgatctttctcctgtttcaccatatcagagttggacactattctaaagttagagattattattcctgtgcctgtaaatacttttagtatacatatgtatgcacatatatatgtatcattttaaaaatatttaagtttcatattgttttgcatgttttgatttgtttgctatttgtattcttttgaacatttatttaatattaagtttggaagagtttttgtattaggtcgttcttgcattgctataaagaaatacctaagactgggtaacttataaagaatagaggtttgattggctcacagtaggctgtacaggaacgtgatgctggcatctggttgacttctagggaggcctcaggaagcttaaaatcgtgggggaaggtggaggtggagtaggagaaagagagaatggagggggagtgctacacacttttaaatgaccagatctcatgagaactcactcattatcatgaggacagtacacagggagatggcactaatccattcatgagaaatccatcccatgatccagtcacctcccaccaggccccacctccaacactggagattacagtttgacatgagatttggtggagacacagatccaaaccacgtcagtttttttttttttccagtttttttcaaacaagacaggctttatttaggtcactaaaagtaatgttttacggaaagggaaccataacattgcacaacaaagtatgctgtaaaatctcaaacaagaaaggcagtgctttctttaggtcaccaaaaatcatgtttcactgttagaagcaaatgtatagctgcattttttcccccaattctctctataatactttgagactactttgcggtttccaaatataaactaaaatttgttggacagagttgctcagtctcatcaatagaataaaaatagcttgcaaaaaatttttgtttaatgccaacaaataacaaaacaatgtggtttctgcttactaactccaacatctagtgaaatggcctaacctatgtatactttcatgaacatttcactgtgaacgcagttgccctttttttctgccatcacagatagcctccttagtagcaagtatcttgtcagagcactttcggacacccaggaagtaattcctaacagaataactatagttatgtgggcaactgaaacaacagggcccacctctgccagagtccccacgtggtgttgcttttgtgctctgggtaaataagacccagcaccttgttagttggaacagttggaacccagagtgcagagctagatggaggagttgttgttacagacccatcaacactttaataaattgccgggggtttctaggtgctatagtatgcctcataggcagcaacataagccaactctgggaagaaatcatcatggtatatattctgctaaaaacttcagaaaagatcaaagtgtttcaataaagccttcagattcttctcagactaggacatgtttccaaggatttctggaagttttaccaaaagtcacagcaaatgttgtgccccataaatgtgaagggggtggaggtgtctggtcacctgggtggtaattatcaggcacaagcttccacgagaggacctcatttatttaattagttcttttcccttcaaagccagtaaatgcagcactttcttccttgctaggaggctgaggaatagttgaagatgatgcacaggtgttttgttctccaggttcaggagcagcctggggcatgctagtagatgtggcctgctgctggcacttgggcgaggtgacgcctgctctcagccagcctgttgcagttggtggtgtggcacgcggaccgcctcagagcctgcaatgcttccggcttggctttgtgccttttgtgggtggctggttcagctgtggttgtctgactctctgtggactgtggtgtggatggattcaacaaaggtgggctgggagagagctccccctggctcattttattgtctgtggtgctttccgtaattgaaagaaaacacttagctgaagtcacctttttatactgagcttattcccatggatagattataactgatgcggtagtgtaatcaaaggttattcttaacccatccaccatctccttacaaaggtcagcattcttttctgctgggaattattataatgcaccttcatgttggtgtgccgcatagtgtggtggtggcaaggcctctcactggctgaaaaagctgtgttgatagcaaaatgcttctcgtaggactccaaaatcattatgatgttggtctgtcgtggaagtctcattaactgtttccttctgttaatgtagtaacgatcactctcaagctgcttgttcagaacttcggggatttctatagttaatattctttcttccatttccctttctgtttacagctccagttcttgcacttaagtctcttcttcaataacacttccttcacttatttttcatccttgtcttcactactgttggagaactgcttattgaattttcagcattttcatctttgtcttcaactggggggcttttttagacagatttgatgccagacagcctgcagcacttccttcttcctgtgcttctcaggtgagctgcagcttttcttgccaattcatgctgtcatccttgatttgcacctgtattacagtgtacgtgatctttggctgcccatctatcacagcttccgttccaactattaaaatgtattagatattctgggatctttctgccttttttgtctttcccaccaataacatcagcaatctgggtcaaacccccaggcgtcccaccagagcccacgtggcactgggctgcacaggaggaaagaagatttaacgcaaaatagagaccatagtcaagaggcctcctccactagctgcaaggccaaaccgcagcctggcctggacagcgcagacacaaggctcccgactggggctgggagagttttccattttgagttctataattcttaattcaggcacttaattgctatgtagtaattccagttttatgaatacaatgtactgcaattatttttattgctgatgatttatttttagaatttggtaaaacaattttagattgtatactctttattatttaaaaaattactatttttaattgacaaatcataattgtatacatatatggggtatagcgtgatgtcttgatatttgtatacaatgtggcatgattaaatcaagacaattaacatatctgtcatgtcgtttacctatcctttttcatggtgagacatttgaaatttacactcttcattattttgaaatacatactacattattaattgacttcagtcactttattgtacaatagatctcaacacttatgcctcctctctgtctgaagctttgtactctttgttcaagaatttccattccctctcttcacatctttctagcctctggtaaccatcattctgtgctacttctacaagttcaacttttttagatttcacatacatgtgagatcatatggtgtatctttctgtgccttgcttatttcacttagtataatgtcctccaggttcatctatgttgttgcaaaatgacaaatttttatttactttttaaggctgaatagtagtctattgtgtatatatactgcattaaaaaaatcagtttatccgttgatagccagttaggctgataccatatcttgtctattgtgaatagtgctgcagtgaacatggcagtgcagatatccctttgacatatttatttcagttcctttggttatatacccagaagtgggattactgagccatatggtaatcttatttttagttttttgaggaacctccataccgttttccataatggctgtattaatttacatctctagcaactatgtacaagatttcccttttctctgaatcctcactaatacctgtcatctttcatctttttgataaaagcctttctaatgggtattaggtgacttctcattgtggttttagtttgcatttccctattgattagtgatgctgagcatttttttcatgtacctgtttgccttttgtaggtcttcttttgagagacacaaatggcaaatgttcaggtttattgcccatttttctttcttttttttttttttgagacgggagtctcgctctgtcgccaggctggagtgcagtggcacaatctcggctcactgcaacctccgcctcccaggttcaagtgattttcctgcctcagcctcctgagtagctggcactacaggcacgcaccaccatgcccagctaatttttgtatttttagtagagacagggtttcaccatgttggccaggatggtctcaatctcttgacctcatgatccacccacctcggcctcccaaagtgctaggattacaggtgagccactgctcccggctgattgcccatttttcagttaggttgttttcttgttattgggttgagttttttatatattaccccttatcagatatatgctatgcaaatatttttttccattttgtgggtttgcttcactttgttaattgcttcctttgctgtgctttttagttcaatgccatgcatttgtctatttttgtggttattattgcctgtgctttaagttgcagaatacaaaatcaacgtacaaaattagtagcatttctgtacactaataacaaactatccgaaaaggaaattaagaaagcaattcaatttacaatagcagcaacaacagcaacaacaacaaaagtaggtataaattaaacccaggcaatgaaatgtcttttcaatcatttaaaattgtaaaaccattctgaagactatagaacactgatgaaagaaatggaagaaaacataggttaatataaagatatcctgtacttatggattgaaagaatcaatattatgaaaacatgtgtactatccaaaacgatttacagattagtgcaatccctatcagaagtccagtgttgtttttcacagaaatagaaaaaacaattcttacaaacccacaaaagacctcaaatagccaaaacggtcttgaccaaaaagaacaaaatgacgatatccaactctctgatttcaaaacatataaagctattgttatcaaaacaggatgatactggtataaaaacaaatacattgatcaatggaacaagttagaaggcctggaaacaaacccactcatttatagtcaattgattttcaacagagatggcaaaaatgcataatgaggaaaggatagtctcttcattaaatgttggaaaaactggctgtgcacatgcacaaaaatggaattggatccttatctcaaaccatatacaaaaatcaagtcaaaaatggattaaagacatataaaacctgaaactgtagaactactaggagaaaacatagggaaagctcctcaatattagtctagacaaagtatattgtttccttattgatgtgttttcgaatttctcttggtctatacttaggttgaaattgctgagttatagggtaggtatgtcttttactttattggatattgccaaattactctaaagtagcagtaccacattatatttcctttagaagagcaagagacttcttgttacttcatattatgtcttcacccatatttgtattgtgagacttatatggatttttgctgatctgaatgctaagtcattgcaggtttattttgcccttccctggttattagtgaatttgaacttttttttcaggttactcagatgttcctctttttttttccagttagtttttttcttctcattggtttgtacaattttttatattgcagattctaattcttggcaattatatgtgtggcttgctttccaattttttatataatgagttttgatgcatgggaaatttcagtattaaagtagtcagatttatctgtcttttcttttacggtttgtgttttgtgtggcttgttgaagaaatccttttctaccttgaaattttaaagatattctgcatattttaaaaaatattttcaagttttccaagttttcctcttttcatttaggaattgagtcttgcccatctcattctttggtgttagttaggaatcaatttttttccttgtatggatagctagttctccttgtacaatttcttgaataatttatcttttctccttaacctacaaagccatcattgctatagtatgcaatgctaggtatgcaatactatagtatgctaggtatgcattgctctgtttctgagctctttagtctgcttgcttttctttttccttatttttataccgatgtcttaattactgaagtgttatagttcttggtatcttctagagcaaatctgcccaccttaaccttctttttcaaaatcaggggctggcaaactatttctataaggaccacatagtaactattttaggctttgtaggccatacagcctttattgcaactgctgaattctgtcattgtagtgcaacaccaaccgtgggctatataaaggaatgagtttggtggtattttgtgtaactttcacatatacacattgttatatattttttctttttttcaattatttaaaattgtaaaaccattgtttgtaagccatataaaacagtgagtagaactttgacttttacttaaaattgtctgtgctatttttttatgccccttttcttatatacactttttgtgaagttaagcttcttattttccctacatgagcaaaaggttatttaaaattcttcagtcaccagtgaaataatgaggcaggagaaaaagttctttaggtggtagtcttgtcatcaaaaataaatacagttgcatggaactgctcaagatctgaatcaaactgaaaaccggaaggcaaggggctgaaaattaagaacccctccaaccatgagttattcttcaggtcaagggaggcgagggcagggagaagtgtctagccatgccatcttagagcagaaggccatagctggatcagatccaattctcatgacacacacaaggaactacacttgtggcacctgagctggattcagatagcagagtgggcaggcaggtgggcaggcagagcagtggttggatgagcttagagctcagtactatagctccatcattctgttcagagcactgccaacatggaaccattgaatcagggtcttgtagaagttcgtggttcaggaggatggtttcctgaatcctcttggagttcttgatgatacatttgaggggcttgacagggcaaagcctttccagccttggatgatgagattacacgcagggtagatcttatagtttgtcatgtcagtaaaggtaagggacagcaggttggtttcttgaagctagtttcctggatcctggtaaagctcttgatgatgatgccctgtctcccaaggtggcagggttctagtggtatatgctcccagcttgccatggctctcatctctgataaccatctatctgatggcatgtttcttacagtagtgggccttctcctggtgacaacattacctaaggagttggcatttattgttttcagtgtttatggcaccaataagcaggttattggagatgttgtactggtgcctcaataacttgaaccatatgccaatattcaaaatgtagtgagtggtatgcttccttttcacttttgtaaggatatgtgaatctgtaggtcatccaggtctttgccttcccacttgtcaaaaggctccaggagctgtaggcacttgttgggtgtgctcatatccaccctctgcctactgatatccttgtggtaggggtgctggtagttgtccttcctggagtcaactctgcttagggaagctcatctgcatctggagcctccaatttgtacttcttcccatacatggttgtcaggaagtaaatctcttggttgaagttgatggtgacagaaatggccagggcttgaggatctctagggacatgatgaaggcttgggcctcaggtttgctttattgtggcctgtcaagttcctcttgtaggaggtgaagattgcatttttctccatctttattatgtcctacctgttccactggccaatgcaggggccacagacagtggccaggacaatgcctgccatatcctatgggatctgtgaataactcttatgctcaatattagtgtagatctgcttagatcccagtgctgtggtgagctgtgacttgcacttgagcccatgagctagcacttgcttggccatagctgttgagcacctgatgtcctcatagcttgagttggtacagctgttgatcagacccactttgatgtccaaaggccatccctccttctccaccacagtacctacttcttccacagtgtgggctaggtcggggtaaagggcttatttacatggggcttcagcttgttgaggttaatttttacctgtcatttataatggcaatcagggtcaggtaccaagtgatccttgattttatcttggattggcattgtctccttagcctgtcttacccagttattgctttattccgtggttctaagagaacactgagggccccaatttctacacccgtgttcagattatcatcaggccaatgtatgagatgggctgtatgctaggctgctggtactccacagtacgcgtgtgccaccttcaggatcacatctgtggatcagatctagcttgagattgtgcctgtcagcttcacaccattcatcttgtggcacttcaactcctaaataatttcaatcctgccgtccactgcatcagcctccccagctccagtgtatatgctctgcaagccaccactattgaggtgtgggagtagtggaataagaagaatcctggggtatatgtagctttcaagaatgatctggtgattgattctaggtccatcttctaaaagcccacactgtagttcacatctgcagttgctaggaaattatactttctgatttatgtccttggcctggcacagacctttcttttccctgagctgagccttgtctggtgatcacagtggatggtggatgatatggccatttggccacctctctgcttatgaactgcactgtggccatacggtccatagtatcctgaatgcctatgcaggtacatcttactctgttcagttgcctggggtcatctaggtatccatacatgatctccaagaggatcagagcctggttcaatcattcgttaacactgttaattttcttttctaggaggtcatagtggatatacttgttgactccagttagctcatggtcaccttggccttttggcacaggactgatgccacatgatatttctgcacactggagggctttctgcaacagggttactaatagagtatgcctgccataagagttctctatttcgtacaaaaatcaattttatggcctatgtttttaagttgctaacaaaataaactcgctttctagcccatatttagcacattgcatttgtgattatagatgaaatcaagattgttaaataaagcagtcatgaaaataaacttttcagatgacatgcaaaagttatttgttttacctctgcagtgctaaacatcatggacataaattagatgatgttagtttccctgtggaaccatttaaaacaactatctattctaaaagtcaaatatggtgattttgatcagaggattagtgttgacattaacattttaaagtttgctttaaatgatataaaattggtcatatcattttatcttcatggaataataaagtacaatcattacttataaggaggaaccacctaacaaatgcctttatttttcagtaatttatagtgttttgttcttaagtataaatcacttgtttcctgccataattttaatgatacaatgttaatatatagttaaaataatttattttttttaaacgcacatgaaattgaattggaggagtttttttgtagcatgaaaacatgctgccaattgcccactttgaatattattctgagaaaatttataacacttcaagtatgtcagtttttcatacttgaaatggattacttcctgactcactaaaagaatagaaatatatttttaaaggatatgagatattttttatatttgaaaatagcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgtacccgggaggcggagcttgcagtgagccgagattgcgccactgcactccagcctgggcgacagagcgagactccgtctcaaaaaaaaaaaaaaaaaaaaaaagaaaatagcatgctttttctttcttttactactcagactaatagtttcttattggaggtacaacttaagatcccccacaaatgtaccaaaaactaaatctagaatccataatggagaaaatcacatttagcacagtatgtattttatgattagagttgccaggtaaaaatacatgatgcctggttaaatttgagttttagataaacaacaaataatgtttgggacacgcttttattgttaatctgaaatttgaatgtagctgatcatcttgtatttttatttgctaaatctggcaaccctaattatgattcagtgtttaaaaatatataattatagatacatacttttctataatcgttgaaaaaagtcttcgagaatatgcagcagaatattaatggtggctgtttctggtggttagaggggaggaaggaagattttaaatactttgtattctctacattgtgttaatttatttcagtatatacgtattttttatacttaagtcacttgttttcggtggagtggcaaagatacagtggatggcaaaaatatatagaaatatctgatacttaaccatcatagagcatatgagtgggaaggacaagaaatcacacatataaaattgcgattgcagtaaacatcacagaagagagatacatcagtgttatgagattatacagtcagaggttctgttggtttggaagatcacagaaaactttcttcaataagtgaagtttgagattagatatgaaggaattcgtgtaggcattaactcggtcaagatgatggcttttcaaacagaatgaagggggagaaataatttggtgagtaggaggaagtaaaggaggggagagagctccagagaaagtagtgcaagataatgctgtagagaaacatagtggccacaatctgtggagacttgtgttccgtgtaaggtttcaggttttcatctttaaagcaatggtaagccattgaaaggggcaatactggtgttaacaggatcagaatgtgttttgcgaagatcattttggttgcagtgtggagaactggtatgatgagtaaatgtatgcatgagagtgagtgttgcttgaccagtaaagagaatgttgtagcagttcttatgagagagaaataggagtttgatcttagtagggaggtttgatgataatttaggaagtaaaattttcaggatttagtgatgctgttgatatgtggcagtcaccaagtgagaagtattaaagttaacatgggtttctgatttgcacaaagatgcaatgaaaaataatatagccaataaaaaatttaaagtaattacatagataaataggttagcaactaaaataaatcacttggataggatttgtaaagtgaaactgtgtgatggcaggaggtaaatgaatcaggagattgtaatatgaatatgcaatatgtaattataatatgtatatataatatgcaatatgaattatatatgatatgaattatatgtatatgtaatatgtaaaatgaattataatatgtagtatgaatcaggagattgtaatatgtaatattttgagttaccttgaaattaattttagttatttagtactgttcatattcaaatagatatcattttaaattataaaattatttcagtatttttagaataaaagaaatgcagtaatggtaaacaaaaaataagaagtgcagattttcttcttaacttttcccagggagacttcccctaccttttataatttattttattggagaaatagatttttgaattgaaaatgctattctgaaataaggccatttgccaacaaatcagtacctaaatgtatcttttctcttaattatgtttattttacagcatttgttgccttatgtcaggtttctctgtctctagttaatcaatccctttcatgtatctatcttttcctatacagattcggattagataattcctatgcttcaaaaccttttatggttctgaaaaggaaagtttaaacttaaagttaactccaactgtcaccttcttgaccagtttatattatgttcatttcttttctccttcctcaagagagagagagagagagtgtgtgtgtgtgtgtgtgtgtgtgtgtatgtatgtgtgtgtgtttattttcatttcttggtatcttcgaatgtgttcacctttctttctggaatccctttttagtctggaaaatactggctgagctttcttgacacagatcaaacattacctctctcaaaatgtggtcaccacctgggagacttaggaatttttgcatagcgtttcatttatacttattctattattttattatataataaattactagtatcagatgtagtataaataacaaatatacatcttacttatactacatgatatcatgtgtacttgtttaactatttccattaaatgtgagttttaaggaaagctgacatatgatagttgttcagtaaacctttgttatgagttctgttaggatggagatgttttgctgttgtctgtggatggtagataaatggacaaataaattatcaaatatcttaatatccagaagggaaaagagacatatatattattaataaatcagtgtggtagtattatgagggatgaaagtactctcgggagtctggaagagagaattctcagtttatcttcataaaggtgcttggctgatgttaacctcctttagaataaagctgtaactgcttaggcttgtgttatattaaatggatcatttttcttgccctcctcctgtggaatcatagcattccaacatttatagaggaaatagagtggaagctaccgaaatgggtccaccttcataatttaaaacttctaatttcaaagttataccagtaataggcagtcctccccttgagtgattttgtttccaataatttctaatgtatagagccctattaactcctattactggttgcaggcaggcattacacaaatgaaatgacctcatccagtttcttttctgaagagttccatcactttgttcctagtctgtttttttctgcagccatcttacacagcatggtgatctcttatgtcataaatagtcccatagagattattagaagaaatgagtggtaataagaataaagttgagttttaaaagatgaaagaaaaatgtatatgaccaggaaaacttgagctttgactaacaagtaaaagaaaatacctggctgggcgcagtggctcacgcctgtaatcccagcactgaggtgggcagatcgcttgaggtcaggagttgaagaccagcctggccaacatggtgaaaccctgtctctattaaaaatacaaaaattagccggacatggtagcgggcgcctctaatcctagatattcaagaggctgaggccatagaatcgcttgaacccgggaggcggaggttgctgtgagccaggatcgtgccattgcactccagcctgggcaacaagagcagaactccatctcaaaaaaaaaacaaacaaacaaacagttttttttggaatgtcttttccaaagggcaaattgtaaaaattgtatgcaataatagcatagtttgattaaatgctttttcttccagactttaagttctaatgaatttacttaaaaacaaacaaaaaacttattattattattattttttggagacagagtctcgctccagacccaggctggagtgcagtgtcacaatcttggctcactgcaacctccgcctcctagattcaagcaattcttgtgcttcatcctcccaagtagctgggattagaggcatgttccaccatgcctggctaattttttcatatttttaatagaaacaaggttctaccatgttggccaggctgtttttgaactcctgatctcaagtgatccacccaccttggcctcccaaagtgctgggattaccagtgtgagccaccacgcccgaccacactatgttcttgatagtcaaccatgtatcagtccttggaaaaaactgataaaagaaaagcagatgtagtgactgtattctgaggaaaattgcatgactgaaacttatgtggtgaaacatttaaccatgtagagttagaagaaacctcagtattctaatcctttgacattgtggagcagtgtgttgtaaaggattaagggattattaatttcaggacaaataaaaatcggttcatcaattttgaaggcacaccttacatgtaaattgaagtgcttatttgaggagatacattcttactagagcagacagacttctttcaaaaaaaaaaaaaaaacaacagaatacccagcacttgtttgcttatgttattacttattaagaaaaaatagcactagatgcattcctggatctgcttattgtcattccatttatttgaccttaagttttgccaaaattctgttttccccccaaagtgactgaacatatttccaaagaagtcttagatttcatatccttgatgaaggctcttcactgacttgtagcagtaaaaactattatgaaaaataaaaacttcgaagactacactgtattattatataatattgtctatgattttatgtaattgtgttttgcattctataaagctttatggtatataaatgtgtcatttataattaaatgtggttgaattgatttccaaaattatcagatccatgattaacaaaataacttgttgtattacccttcttgttataagaaaaggggatttaagtcttatttcctgattttgtaacatgttataactacaaataatccttgtttagggtaataaaaatagaaacatttgctttctgagacttggatagtatttggaaatatttgattcaagttgggaagtgatttttcactcttaatagttgaaaatttacaacttttagggaaaatcgttgtgagcattctactgtagccccctccccctgcctttttttttttttttttttttttttttttttttttttttggtatttcagagtctgtgctttctaaacaataaagaacaaatatcccaggatacaaagaaatgggaaacttaaaactaaaatttgctgtttcatcagattcctgagagtggttttaattttctatagatgtctttagtatgttcatgtgcctggaatttatataatttatttgttctaaaactgcataaaatttttttacatttagaaagcatgtcaaaattggatttttaaatggaaatatcctattatggttctgtttagaattttcttatatataggacaaactatattattttagaaattcattctggttatttatggagatgtcttttttagctgcctctattcagaattcaaagttattaaaataccaagaatatttagaatatttagtgaggccaaggctcaatagtgttttattttgtatttaaaaaatttctttgtctcgctgtattgcctaggctggtcttgaactccttggctcaagcgatcctctcaccttagcctcccaaagtcctaggattataggagccacatgcaaggccccagcagtctttggagacaaaaaatccagctctgattcgggcaacactcagagtggatttttagcctagggagagaaaaataaatgatataaaaaacagacaaacaaaaaacctagtcatgggagaaagggagttggagagtaagctttggaagagtactatctataattctgttagaacagaccttctgaaagggggcaaggagttttaactccattgccattatttgttggagaatataatttccctcaggcatttagggcaaggaaaaggttaagaactgctgtaccaattaagttctaataatctaagcttactctgttaacattctatctcacttagagtgatttttcccctttaatgtaaatcagcttatgccattcccctattaaagccccctcttttcatattgtgaattaaaaattccaactgcttttcttaacttaaaaatcccctactggctgggcgtggtggctcacacctataatcccagcactttgggaggccgaggcgggtagatcatgaggtcaagagatcgagaccatcctggccaacatggtgaaaccccgtctctactgaaaatacacaaattagctgggcctggtggcacatgcctgtaatcccagctactcaggaggctgaggcaggagaatcgcttgaacctgggaggcggaggttgcagtgagcctagatagcgccactgcactccagcctggagacagagtgagactccatctcaaaaagaaacaaaccaaccaacaaaaaaccctacctacctctctaaatgaatgtatgactctgccctttccttcataccaagtatgttcctatttagggctgttgttctagctgtgccttttgttttgcttggttgtcttactgttttgtacttgactggtcgtatgtcagctcacatatcagtttcataggcatttgtgaccactcaatattaatatgtcatccagttctcttttctattacttataattattataattatacttgtcacaatctgatgttttcttgtgtgtttgcttctttgttttatttctctattaactactatattgttagtgcttggcatagagttggtgcctaagaaatatttgttggatggatgagtgaatgaaccactgccctaggttaggggtgctacccacgtcatatcattgtatctggtgcaggtaatattatccacaattttcagaaactaattgcttatattataatttttattggggtgaaaatagaggcctaatattaacactgaaaaagaattttcaggtcgaagactggaaaactgatttaagtctcagcacttttacttgtaatttagactgtcactatacctttgtgactatgtttctttttctataaaataatatctcaaagagttctgagatttaaatgaaatggtgtatttaggagtttttcataaagcactaaataaattattttacattctctcctaccaccctaaaaaagaagtaaaatacttaaaaacaagcatcttgggcaaggcgcaggggctcacacctgtaacgttagcactttgggaggcccaggcagggggattgctggagaccaggaattcaagaccagcctggacaacatggtgagaccctgtctctacaaaattttaaaaaattagctgggcatggtgacacatgcctgtggtcccacctactgggaggctgtgctgagaggatctcttgagcccaggagatcaaggctgcagtgaactgtattcgggccactgcactgcagcctcagggacagagtgacaccctgtctcaaacaaacaaacaaacaagtatctttaccatttttttttgataaagtaattttaaaaggtgagctttacttttatattataattttactacatgtactatccaacgatggaagttaaaattaattactttggagaatctctagtattattgaatattttatgaattgcaaacttatagactgaatactttcttcaaccttttctgtattagctctttcatttctgttttacttcctttcctatgtcataatcatccaatttcctttgtatttatcctttatctattttgaaatctatttttttgctttctgaaatatttattatagaaaatgtaattaatttactagaaacatagatatatttattcacctctaggctttgaaaaccctgaaaaaataaagctaattcaacttttctacgttaatttcttctatgtgaaaacactacattcaatctaattgatcaactcctaagcacaattttccttttctgcatctgtattttcatgcaaatattattaaactgatcagaatgccctttcttcctctacctcacctattcagacctctatctccagaaagattcagttcatctcctttttcactgactttcccagcctgctgtatctgaagtggttgcttatgttttttataccatgtcaggtattatttgtaattaatcatattttaccctttttaatatcttatttttttcattaaccgttggtaactagtcattttactttttctattttattttgtggtttctgtcactatatgtttcagattaacaaactgttatgtttctaatagatctcaagctcttttaggtctcttttcatagcatctgtcccagcatttttattcattttgtgtgcctaataaagtttttttggtttgtttttactccccattaaacagccatttattttattccaaaaggaaataattgtgtgttttgtgagtgacaatattgtgatgtgttcagtggtatacttcttgtggccacattacttagatttgatcccccattttagtacttaatagctgtagggtcttagtaaagtcattcagcctctctgtgtctccgttttctcatctgtaataagaagatcttttagggttgctgtgtggattaaatgagacagtaaatgtaaaatgcttaacactttgttgtcaattaagtactaacaatcttcatcaacattagttaaattattttatggcataacggaaagaggcgcagaagtcagatagactgtactgcttatgtgaccatgggcaactttctttgcttttctaaaacccagtttcttcattggtaaaatggggatggtttattttgaggattaaatatcacacacacacacacacacacacacacacacaccacacacacttaatatatgtgcccagtgacaattctctttttgcatttgtattgctgctgtttttctgaagccagaccgctgctcctctgcgtccatccctcatgtctgtctgactgattaaaagcatcttgaggaagttttgactgcagcagttggtttggtgccttcagaagatgaattgtgaggaaactccatgtttttctaagagtccattacattcagaagatgagaactgaataaaaatgttaatctgaggaacagattttgggcagtatcagtgtgggtttcataatactggactatttaattataatttgtaccagtgtcccactattcattggtaaaggagtcttgatttgtgcttaataataataatatattcattgagtgtaaattagtgatttcatctgacagtagtgtaaagatagttgcttatagagttattttctttacacataaaataccgtaaccatatgagaagaatgtcaacacaaaccaaatatttattcgaaaagattataaattcaaaatattttctatacccagtagtcaaaaaccttcaaaaattgttaatgttttgctttttcttttggactagagattgtttcagttggtattcactctgaggggtggagagtctcactttaggacacatctgaagaatagcagacagttatgagaggctgttagcaccaccttgtggtgtctgctgtaccctgccttttacctttagtgccctgccattattatatagatcttgataaccagggaaagataagtagggaagacctcattttaacaattatcttttgaaagtacatgcaaattttgatgattgggtactgattactattgaatccttaatatttccgtaaggttttacgtgtaagatcttgcctattataataattgatttaagtgtttcagattcttaggtatatattaacaacatagctttgcaagtacagaaataatgttttaagactactctagtagatacaactttttctctaaattacattattataaataagtccttttttcttaaaattattttagaaattagtatttaagtgtggtgtatttgatgaattttttcttgtttgctgtcataaaatgcaaaaaatgtagtccttgccagtaaccttaaaacacaattttaatgttttttaacagaattttatagtcataaaataacattgattttagaaacaacattttttataacagagtattttcttccaagattctattttagagttttgtactttgaacagttggttccttaatgttattgtccattagcctatttttagatttttctaatttggcttgaaagcaaaatgtgtcattatattctggattgtggggtttatgtaatttctaataaatatttcaatgttcatgaagagagatgaacataaaggctaagaatcgtaagtaatgcagataccacaatgaaagacattttgtattttagacaacaaagtgaagtatatactagatatatgacatctttcatgtaattaaaaaaggtacaaatatctttaaaataaatttaaatttccaaagtttactatgttagtccaccttgtatatttgtaataaaattaaacaacagtttaaatgtagagttaaatagaattagcttaattcaatacgtggattaaccacatagtaattatacattgagtagtgtgcccattctaaatgaaaagtatggcctctacattagaatcagcgtacaaccaaaaccatgtgtattactatacttcattgcaaagaaaacaggatctctctctgttgcccaggctggagtgcagtgataagatcttggctcactgcagcctctgcctcctgggttcaaatagctctcctgtctcagccttccaagtaactgggactacaggcacgtggcaccatgcccagctaacttttgtatttttagtagagatggggtttcaccacattggccaggctggtctcaaactcccaacctcaagtgatctgcccacctcggcctcccaaatgctgagattacaggcatgagtcactgtgcccaacctgttttttttttttccttatctttctttctttctttctttctttctttctttctttctttctttctttctttctttctttctttctttctctctctctctctctctctctttctttctttctttctttctttctctctctccttccttccttccttccttccttccttccttccttccttctttctttttttttgttatggagtctcactctgtcacccaggatggagtgcagtggcacgatctcagctcagtgcaagctccgcctcccgggttcattccattctcctgcctcagcctcctgagtagctgggactacaggtgcccaccacctgcccggctaatttttttgtatttttagtagagacggggtttcaccatgttagccagtatggtctcgatctcctgacctcgtgacccgcccgtctcggcctcctaaagtgctgggattacaggcatgagccaccccacccggccatttcttttgaaaacattttgttataaacttgaagatacaacaaaatacgacttcttaatttatgtaacgttgttattttatgattatacttttttcatggacatataccggcttgagtatgatctactggcaagggcaaaaggtggtgtagctagtctgttacctaagaattgtagtgccactgacagaagtaagggaattaacaatggaagataattatgatatgtaagttaagttcttagtcattttcaaaaggttttcttgggtagattatatattctttcagggatattggttttgatttctataaataaaatatttattattgcatcattatttacatcactataggatattattgtcctttgagagaaatcatcactctcaatccgttcttttctgttctcttttaccaggcagtactgcttatgcccacaggctttaggggagacaacactgggattgacttgatatgtatagtaactttgaaatgttaccacttctcaatgatcctcagtttcctaatctgtaaaatgaagataatacctggcacatggtaataagcactggataaataatggctgttacttggaattatcattagaagagaatcagaatgatcttatcagagtctcattggaaaattcattagacactcacctgcattattgaggaactgataggtgttcagtgcctctcagtttttaggctaagaaaccataccttgtcaaatcaggagttagcaaatttttaataaaagaccagataattttttaggctttgtggcatggtctttgaatggtctcttttgaaactactcaactctgctgctttagcaggaaagtagaagcatttcctgctgttttagcaggaaatggagaaaaggtgtgttattttgtatggcttcctttaggcatatatagaagccagtgtccttaaagacctgctataaagaccagcttgattaaattataccccactcttgcctattattttaaccctactaggttttcattttttgaatgtgcctaccagagcactgtctctccttgcgcacaggacacactgagtcttttctcctctttgtctttctcttggaagattgttttgtaggattggttaccttagccagataattcaacaaacttttagtgctggaacatgatgcctgtataggaaagctgaaggcagaactatttttaggtctccatgtaattttttatctaagataatgatgattatgataataatgatggagtagctattactttttaagttcctactgtataataggcatgttataaatgtctcattcagtcttcataacaaccctacaagttacgtggtgttagtctcattttacatttaagaaatctgcagtgaagtgatttggtcaagaatacacaacaatcagtgccagatatgggcacacacctttgactccaaagtcttctgctcctctctgtttccattaaactttgaccatgactaggacattcgtttactttgttgtttttactaaataaatgttgataagggcagctattatattttaatttgtctttttttttttttttttttttgagacggagtctcgctctgtcgcccaggctggagtgcagtggcgcgatctggctcactgcaagctccgcctcccagtttcacgccattctcctgcctcagcctcctgagtagctgggactacaggtgcccgccaccacacctgctaattttttttatatttttagtagagcccgggtttcactgtgttagccaggatggtcttgatctcctgacctcgtgatcctcctgtcttggcctcccaaagtgctgggattataagcgtgggacaccgcgcctggcctaatttgtctttatgcctttagtttcattatagtggataactaataaacgttaatttagttaatgattgaataattgagggcagattcaatataaatgatgaagtaagggaaaaatggtcttatttgaattagaaggtctccattggaaatgtagtatgagtaaagaggaacatttaaaataaagtgtctttcctaaaacccattcagggcatttaggttttaaatgcctctccattgtgtgtatgcatcacattttaaaaatctgttcatctgctgatggccatttatgttgcttccaaatcttggctattgtgaacagtgctgcaacaaacatgggagtgcagatatctctttgatacactgatttcctttcctttgggtttatacctagcagtgggattcttggatagtatggtagctctatatttaccatttgtatgtcttcttttgagacatgtctactctggttattaatcccttgtcagatgagtagtttgcaaacattttcttccattctgtgtgttgtttcttcactttgtcgattgtttcctttgctgtacagaagtgttttaacttgatgtgaccccctttgtcgatttttgcttgtggggtattactcaagaaatctctgctcagaccaatgttttggagagttttctcagtgattacttttagtagtttcgtagtttgaggtcttagatttaagtctttaatctacttggatttgatttttgcatatggcaagagatagagggatggggtctagttttattcttatgcctatggatatctagttttcccagcaccattcattgaagagattgtcctttccccaatatgtgttcttggcaccgttgttgaaaatgagttcactgtagatggatggatttgtttcctgtttttatgcctgtgccatgttattttgtttactgtaactctgtagtaaaacttgaaatgaggtaatgttcaatttttttctttttagtcaaaattggtttggccattttgggtctgtttttgattccatattatttttaggataattttttggtttttctgtgaagaatgtctttggtattttgatagggattgcaatgaatatgtagattgctctgggtagtatggacgttttaacaatattgattcttctaatccatgaacatgaaatatatttttattttattgtgccttcttcagtttcttgcatcaatgttttatagttttcgttgtagaggtctttcacttccttggttaaatttatttctagttattttatttgtagctattgtaaatggggttactttcttgatttctttttcaaagattgtttgctgttggcatatagaaatcttactgatttttgtatgttgattttgtatcctgcagctttactgaatttatcagttctaatagtttttttggtggagtccttaggcttttccaaatataaaatcatatcatctgcaaacaatgataatttaacttgtttctttccaatttggatgccttttatttctttcccttgtctaattgctcagctaggacttccagaactctgtggaataatagtagtgaagtgggtacccttgtcatgttccagttctcagaggaagggctttctgattttccccattcagtatgatactagctgtgggtctgttatatatggcttttattatgttgaggtatgttccttctgtactctgtcttttgaggatttttatcaggaagaatgttgaattttatcaaatgctttttcaaaatcagttgaaatgatcatatggttttctccttaattctgttgatatgatgtatcacattagttgatttgcatgtgttgaaccatacttgcatacccaggataaatcccacttggtcatgatgaatgtttttttaattgtattgctgtattgctgaatttggtttgctattattttgttgaggatttttccatcaattttcattatagatattgtcccgtagttttcttttttttgtttttgtttttgagacaaggtctcactctgtcacccaggctggagtgcagtgacatgctcatggctcactgcagccttgaccttccaggctcaagtgaccctcccacctcagcttcccaagtagctgggactacagacatgtgctaccatgcacaactaatttttgtatttttagtagagacagggtttcgccatattgcccaggctggtcttgaactcatggcttgaagcaatccccctgcctcggcctcccagagtgctgggattacaagtgagagccactgcgcccgttgtagttttctttttttgatgtgtctttgtctggtttttgggatcagggtaatacttgcctcgtagaatgagtttggaagtattaccttctctattattgaaaatagtttgagtaggattggtattagtttttctttaaatatttggtagaattcagcagtcaagccatttggttctagacttttctttgctaggagactttttgttacaggtttgatctcattacttgctattggttggttcaggttttgtatttcttcatgcttcagtcttggtaggttacatgtaacaaggaatttatccatttcttctagattttctaatttattgttatatagttgctgatagtagccactaatgatcctttgaatttctgtggtattggttgtaatatctcctttttcatctttgattttatttgtatcttacctttttttttttctttatctggctaaaactttgtcaattttgtttaccttttcaaaaaatcaatattatttcattgatcttttgtattttcttcatttcaatttcatttatttctgctctgatctttattatttcttttattctactgatttcagatttgcttgctcttgcttttccagttatttaagatatatcattaggttgtttatttgaagtttttcttatttttgatgtatttgtttatagctataaacttagttataaactcccccttagtcctgcttttgctgttttggtatgctgtttccattattatttgtttcaagaaattttccaattttcttcttcttcttcttcttttttttttttttttttgaggcggagtctcgctctgtcgcccaggctggagtgcagtggcacgatctcggctcactgcaaccactgcctcccgggttcaagcgattcttctccctcagcctcccgagtagctgggactacaggtgcacaccaccacgcatggctaatttttgtatttttagtagagatggggtttcaccatattggccaggctggtctcgaaatcctgaccttgtgatccgcccccttcagcctcccaaagtgctggaattataggcatgagccaccatgcccagccctccaattttctccttaatttctttattgatctactggtcattcagggacatattgtttaattttcatatgttcccatgttcctcttgttactgatttgtagttttattccaccatggtcagagaagatgcttgatattatctcaggttttttgttgttttttttttttaatgttttaagacttgttttgtgacctaacatgtgatttgtccttgagaaagatccatgtgctaaagagaagaatttgtattctgtcgccattgaatgaaatgttttgtaaatatctattaggtccatttggtctacagtgcagattaaatctgatgtttctttgttgattttctttctgacagatctctccagtgctgaaagtcgggtgttgaagtctctaccttttattgtgttggggtctatctttctagctctaataatatttgctttatatatctggatgctccagtgtttggtatattaaaatttacaattatatccccttcctgaatttaccatatatcattatataatgacctcctttgtctcttaaagtttttatcttgaaatgtattttgtcggatataatatagctactcccgcacttttttggtttccatttgcatggaatttctttttccaccccttcattttgtatttgagtgtctttatgggtgaagtgtgtttctgtaggcaatagatcattgggtcttgtttttttttgtttttttttttttaatccattcagccactctatgtcttttgattggacaggttagtccatttatattcagtgttattattgataagtaaagactttcttctgccgtttcttattgttttctcaattgtggtcttccttcttttctattttcctgtcttttttttagggaagttaattttctatgatggtattatttaatttcttgcttttattttttgtgtatctgttgtatgttttttgatttaatgttactatgaggcatgcaagtactatcttataacgcattattttaaactgatgacagcttatcactgcttgcataaacaagcaatcaagaaaaatgaaaactaacaaaaactctacacattaactttacccccttgctttttaactttttgttttttctatgtatatcttattgtactgtcaatgtcttgaaaagttattgtagttattgtcctagattggttcatcttttaatctttctacttaagagtagtttgtacaccacaattacagcattacagtattctgtgttttttctgtgtgcttactattaccagagagttttgtaccttcagatgttttcttattgcttaatgtccttttctttctgattgaagaaattcctttagcatttcttttaggacaggtctggtgttgatgaaatctctcagattttgtttgtttgggtaagtctttatttctccttcatgtttgaatgatattttcacaggatatactattctagggtaaaaggtttttcccttcagaactttaaatatttcatgtcactctctcctggtctgtagtttccactgaaaagtctgctgccagacatattggagctcccttgtaagtttatttgtttcttttctattgcttttaggatcctttcttcatccttgacttttaagagtttgattaaatttcataagattgtcttctttcggtcagatctggttggtgttctgtaaacctcttatacctgaatattgatatcttactcctggtttgggaagtcctccgttactatccttttgagtaaactttctacacctatatctctccctgcctccactttaaggcaaataactcttagatttgaccttttgaatttattttctagatcttgtagatagatgtgctttactcttctcttttttcttttgtctcctctgggtgtgtattttcaaatagcctgtcttcaacctcctgggttcaagctgttctcctgcctcagtctcccgagtagctgggattacaggcgtatgccaccacgcccagctaatttttgtgtttttagtagagacagggtttcgccatgttggccaggctggtttcgagctcctgacctcaggtgatacacccaccttggcctcccaaagtgctgggattacaggcgtgagccaccgcacctgaccatttggttccatttttaaagggattggggaagggagatgaaccatgccactccaaggagatttagttctaagactattgttaattattgggaaagaaagagaaccaagggaaataaaacctcagtaagaagactgttgttcttttcataaaatcaaatgtttttaaaagcctaattttattagcatttggtgcttggaccattctcttgaaaatgctgaagaaagagacatatgatagccttagtttttgtatcctgattctgtccttttgaccattccttaatttccttttcaggtttctcttataatttgattagcctaactgctttcttcactgtagttcagttgcagttctagctctgggagtcccccctaccccaacacacacacaatgttagcttatgtattttaaatgcttctcaatgtgtttatatgggtaaagatgtcccataaatgtccctaatttcccaaattaccatcttcatctttctcttcaaattcattttttttagtccatttcataaatgattgtaccattgtatcctctcagtgcttcaaactatttcttcctgtatcttaaatctatttagttatagaatattatttctgtctctaaaataaaatatttttagaaatctgttactcttttcagtctgacttttactatctcaggtcatgcctttgtgatttttgtcccaaatgccttaaataattttaaaaatagtggtgctaaatagtgtttacctattttgtaccccaaatcccccaatccatagtccatgctccattcatttttattttccttaaatgcacacttgagattttatttttccccaggtgtatttaagtctttagttgtatttcatgctcccagaataaaagattaactccctagaatgggcattcatgatctagccatattctctatgtatttttgctccatcctttcaaaactactcatgttcctgaacgtatcatacttttccttatttccatgttgttgcacaaggtggtgtctatttctgtgattttctttcctgcttcttgtatgattggcagaatccttctccttctttaggactctgcttaaaaatcgtttgtactgtgtcccttttcctttcattgtgaggcatgttaaccctaccctttccatagttttaaagttgtacctatcccttattttataattgtttattgctgttcctctttcccactatcaccacaagattccttgagaatgctattttcctttattcatctttgaaccttgagtcgctagcacaataatttgaacataaatgttagttaaagaatgaaagaaagggagagggaaggaagaggattgttatgttgaccaaattatatgcataggataaaatgaaatatatatagatttaaataggcaagtaagaccaatttatgacacctggtttaagccacatacatatccgcaaggcataggagtagagaacaccttgattgataatcccaataaactatatgtgattgtgaggcagtgggcacgagtctgggttctgtcaggttgtcctgtgtagaactggtggaagcccacacagaactggaataagaaacaatttaggcttacctggagagttagggttgtctgggacaaggggaaaggaatgcttgagagtatcatctactttgacacaggaaaaatgacacaggaaaaggctcttcataaaagataaagcagttgtttttagaatatatactcgttggggatactaacttcatgggctacaatgttgaaacaactagggttttaagtcatcaaatatgaggagtttcatctatagcaaaatgttaatattgattaataaaacttccttttcttctccctccttttttgttgatcctacagtgtccccagtgattctatattttttatataatccaaataaagactaaaggaatagcatacataaaatagtattaccctgaaacattggaaactagtccagaaaacagttttacctgtcattagtaatcacagtgtgtcttttattgagtactatttggagtattctttgatttgaagcatactttacaataactacttctggatgaaatggagctacactttgtaataactgcttggaaaattaaagacagatataataatatatttatacatttattcaacagattttgtattttttaagtgccagtcactgtgcttggcattggatgtaatttgaacaatacaaatggtctctgatatgaccttgcattccatccgaggaggtaataagcaaataattacattattataaatgttaataacaaacaaggtaatgtgatataaaagaatgggaaaacctaatttgatagggtgttaagagacagggctctctgaagagatcatagagaagtgatctaacctgaaggggcagcgaagaatttgatatattgaagggtagctggagtatggtcaacagggagagtgccactggatgagaattcagagagaggcgagaatcagcttgtatacagctttgtaggctatggtgagaagtttggatttaatttagattggtaaagcagtgtttaggcagaagaataacttaatctgatttatcctctaaatgcataaaatctgtagatgtctacatatattgagtgaagggcttttttttttttttttttttttgagatggagtctcactctgtcacccaggctcaagtgcagtggcgcaatctcatctcacagcaacatctgcctccagagttcaagtgatactcctgcctcagcctcccaagtagctgggactacaggcgtgtaccaccatgcccgactaatttttgtatttttaatagagatggtgattcaccattttggccaggctggtctcgaactcctagactcaagtcatccgcccatctcggcctcccaaagtgctgggattacagatgtgacctgctgtgcccaaccttaagtttttattataaaagtaattatatctttagtaagtaggttttggaatattaaaatatggaaagcagaagaaaaataactcaccaccaaatcacaaaccgcttgaaatttttttaaacatatatccttctaggtttttattctactgatacttatttgacatttattaaattgtatttaaaatctctgttaatgtcacaagaatgttatcattatcacatattcttcacaagtatctttaaaagactactaccattttgttacatggctaacaccacagtttgttgaaccagtcctcagttttggacctttagatggttctatgggaaatttttaatattaagcaatttatttccttagcatagatttctggaaatggaattagtaaaaaggtattaactttatagatgcaccatttattaaatagggaatccttttcccgttgcttgtttttgttgggtttgttgaagatcagatggttgtacatgtgtggtgctatatctgaggcctctgttctgttccaagggtttatatatttgttttggtaccagtaccaggctgttttggttactgtagccttgtagtatagtttgaagtcacgtagcgtgatgcctccagctttgttcgttttgcttaggattgtcttggctatatgggccatgtgaactttaaagtagttttttccaattctgcaaagaaagtcagtggtagcgtaatgggaatagcactgagtctgtaaattactttgggcagtatggccattttcgatattgattcttcctgtccatgagcatgaaatttttttccatttgtttgtgtcctctcttatttccttgagcagtggtttgtagttctccttgaaaaggtccttcacgtcctttgtaagttgtattcctagccatatgcagaaaacagaaacttgacctcttccttacaccttatacaaaaattaactcaagatggattaaagacttagatgtaaaacccaaaatcataaaaaccctacaagaaaacctaggcaataccattcaggacataggcatgggcaaagacttcatgactaaaacaccaaaagcagcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaacaaaaaacaccaaaagcaatggcaacaaaagccaaaatcaacaaatgggatctaatcaaactaaagaacttctgcacagcaaaagaaactatcatcagagtgaacatgcagcctacagaatgggagaaattttttgcaatctactcatctgacaaaggtctaatattcagaatctacaaggaacttaaacacatttacaagagaaaaaacaaataaccccatcaaaaagtgggtgagggatatgaacagacacttctcaaaagaagacatttatgtggccaacaaacatatgaaaaaaagttcatcatcattggccattagagaaatgcaaatcaaaaccacagtgagataccatctcacaccagttagaatggcgatctttaaaaagtcaggaaacaacagatgctggcgaggctgtggagaaataggaacacttttacacagttggcaggagtgtaaattagttcaaccatcatggacgacagtgtggcaattcctcaaggatctagaaccagaaataccatttgacctagcaatcccattactgggtatatacccaaaggattatgaatcattctactataaagacacatgcacacatatgtttattgcagcactatttacaataggaaagacttgtaacccatccaaatgcccatcagtgatagactggattaagaaaatgtggcccatatccacagtggaatactatgcagtcacaaaaaagaatgagttcatgtcctttgcagggatatgaatgaagctggaagccatcattctgagcaaactaacacaggaacagaaaaccaaacactgcatattctcactcataagtgggagttgaaaaatgagaacacatggacatggaggacaacatcacacaccggcacctgttgggaggtggggggcaatgggagagaaagcattaggacaaatacctaatgcatgtagggcttaagatctacatgatgggttgataggtgcagcagaccaccatggcacatgtatacctatgtaacaaacctgcgttttgcacatgtatcccacaacttgaagtaaaattaaaaaaaaaaaaagaaaaagaagttctgagcttttcattgtcaaagctgtctataattatctttattattttagtagtgtatattgtgattataaagtcagaggacaactttggaacatcttaaagcattaattactgactcatagtttgaggttaccattacatcttcctggtggattctgtgacaaatgagaaataagacacataagtcagatagaaggagataaaatgttaacttaggccgagcactgtggctcacgcctataatctcagcactttgggaggctgaggttcactttgggaaggatcacttgagctcagtagttcaacaccagcctgggcaacatagtgaaacatcgtctctgcaaaaaatataaaataaaaatagccgggtatggtggcacccctgagcctgagatgggaggatcacttgaagatgggagattgaggctacagtgagctgtgatcatgccactacactccatcctgggcaacagagtgagaccctgcttcaaaaaagtaacaaaaggaactcttctgtttttaccaacatatttaccctttgttcttcattccttctgtagaattaagtttatatctagtataatttcctttcaatctaaagcatttatcttatagtttattgtagcacaaattttctgaagacaaattctatcatttttattttgtcttcatctttgaaggacattttcaatgggtatagaaatctaggttgaattttttaacatttaaaatattctattattttctggccaccattatttctgatgagaaattatccttatcgtgatttccttatatgtattgtgtcttttttttttcttctggatgatttaaaatttttttctgtgtttggttttctgctatctgatgatgatatatctagatctggtttctttttatttattcttcttggggtttgctgagcttttttaatctattggttgatatatgtcagtttgggaaatcgtttttcacctctgatattatatttttaaaaatctaatattttcatttcactcttttttatactttctctctgctaaaatttcccttcaattctaacatattatctaccctttttaattatttgacatctatattattattagagttgttttaaagtccttgtttgataattccaatatctgggccacttctgggactggtgtattgattgtttcctctttttataatgagtcatttcttctggcttttttatatttcacagtagtttttaatgtaatgtcaaatgttgtatataaagagaatggagcctatgataaataatgtttatgtccaaaaaaatacatgcctcttcttttgtcatgatattagtatagttccgttggatctggtctttggcttttattccatacttgagctgtatcttattcttttaaaatttatattaagttcactacaggaccctgtgttttttgagagcaagattaggatctttgtttttgtatggtttgtagtttctgcttagttctcctgatacaccttcagaattccacatgccttgttcacttgtgccttagggaggtatctctcttagtgcttctttctttctaccagacacagattgcccttcctggtactcagtttaaggtttagagtacgcatgagatttcttttcattctcctgcttcgcactcagactttattcgtatctatgggcctgcacttcaccgggggtctttctcatctctccagccttgcttcttgtcattctcatgaacaattgatcgacacctgtggaaaatagatggcaagtgggtgggatcccctgtgtctagagttctcagtgattctaaactatcatgcatcccccaactgggtcttttgacatttttttaaaagtgcagttattttcttcttatcaactttcttctccttatcctactctgccaagaattatagccactattcatttcttctctcctataagagacctttgacttttatagtttttattcattggattcccttaggaactctgctctgatgaaagctgaaaagctttgatagattacatggctcgttgttgctacaatgggatagaattcccttgcaatttcctacatcctacgagaagaggaagtaatgagctaccatacgcacataccatacatgtatgtattgtaccatacatacataagctacaaatcttatgattgatttatactaaatttgacaattcccctagataaagttgctagtagttggcagctcatcactgctcttgcatttcttagtctctgattcccctcttgcctttatacattacctttgtttttgaagtagtgattcttctttcatttatttttcttgttttcttaactgtttagccaaaattatccaaattattcttaaaaaattagagtagcacataatttcttaggagctatacaaatctacaaatttctttactatagctgcttagtagaaaaatagtgagttttaacaacttagatgtaaattaatatgtttgtgtttttttgtctcgttcattggtttaagaaaaaacacaggatactttttcctaatataacttgatatattataggacagtctcattggctggcaagcttctatagctgccaagaggcatgtatgtttaattttaatactgtgcatcttcggtctctaactcttatttcggctctcattcttcagcgtagggtgtaactgcaaatgacagtggcaccctgatttaactaatgggtgaaggctgagaagaatgtggataagtgagccatttgggcagtgaggagagcagtaaaccacacttttctcattagttgtctcccaggctaaaattaaacagaataaaatactgccaaattttagtgatctatggtggatgtggtctgtgtcaactcaatatcaaactaattacccagatatttatatgttagaacttgtgtgctatttttaaaggttggtatcttgtgaattgagtatatgatgaaaatctctctctaaattaaagagaacattatctctaaattgtaatttcaaccaaattgatgttaaatcaatgaattaccctcttttatcatctataacattcgtaaattttaaggctggctgtaagtcatgaggtcgtttttggtataatgtaatcatataacttacataggttggtgaagtatttttaactttttaattataataaaataagaccttcaagtttaattttccatttgaaaatatttattatatttgttttccgttttctctctctaaaatctcaaataaaatggtgtaccaatcacatgttgagaatttgtttgaaaattcattgaacacatttagttttagacatatctgaaaagacttctgtaacaatttgtacaatatggaggttatctgtaatttcttaacatacttgcatcttgtccagtttgcatacatttaaatttatatgccattttgtttactaggttttgaaattttttcatcataattaaaaaatatatagtatataatatggcctgtacttagatgcataatctaaaagaacataatcctgagttatttaaaaaatcaactcaatatcttttttctttctttactgttttttcaatgtaacattaggtatgtataaaaataggtaacatatatgtaagtattgaattaaaattatataatgaatatcatttactgttggctgagaagttggtcataaatttatttgcttttatagattctttccttaggtgatctgtctttttgagtacttttctgatcttctctttatcttcacttgtttacagcttctttttttgcttagtgtagatttattttaattatccagtttagggtttattgggcctcctagatttaaggtttactatctttcaacatttctgtaaaatactcagccattaccttttttaaaaaccatattgtctcttccccattctctattatctctctcgagcccaataagacatatgctatgtcttctcactcagacctctctatctctaacttcattttaaaagtttcattatttttcaatctgggcttacatcctaaactatcttgttatgtatcttccatttccttaattctctcttcaactgcatctaatgtgctttttaacatgtttagtgagttttgtacttcaacaatttgtcatttctgtgattttcatttttctttaaaatctacttgttgctgatgctttctcatagtttatcttcatgatttcataagtgtgtttttaaacattttatacattatcaggggaaccagcccctgataattcaacgtaggttcttttctattttccctaagtgttggctggtcttagaaataaagagaaaggctacaaaagagagaaatattaaagctgggtgtctgggggagacatcacatgttggcaggttctgtgatgccccctgagctgtaaaaccagcaagtctttattagcaattttcaaaggggagggagtgtatgaatagggtgtgggtcacagagatcacatggttcaagggcaacaaaagatcacaaggcagaaggtcagggtgagatcacaaggtcagggtgaaactagaattactaatgaaattccgtgtcccgctgtgcactcattgtcattgataaacatcttaacagggttcaagaggagagaaccagtctgactagaattcgccaggctggaatttcctaatcctagcaagcctgggggcgctgcaggaggccaggacgtgtttcatcccttacctgcaactgcataaggcggacacccccagagcggccattttagagccccccccccccggaatgcattcttttcccaaggctgttaattattaatattccttactggggaaataattcagtgatattcctcttacccgttttcagtaataagagaaatatggctctgtcctgcccggcccacaggcagccagactttaaggctatctctcttgttccctgaaaatcgctgttttcctgttcttaaggtgcccagatttcatattgttcaaacacacatgctttacaaacaatttgtgcagttaaagcaatcatcacagagtcctgaggcgacatacatcctcagcttatgaagatgatgggattaagagattaaagtaaagacaggcataggaaattgtaagtattgattggggaagtgataaatgtccatgaaatcttcacaatttatgttcagagattgcagtaaagacaggcataagaaattataaaagtattaatttggagaactaacaaatgtccatgaaatcttcacaatttatgttcttccatcagggtttcagcaggtccttccatttggggtccctgacttcccgcaacaatacatagctgttttatattctgtattctaataccttcagtgcttgaggatataaatgttttgttcattaatatttttgactcttattaacagtggtttattttctgcacttcttgctgatttttttgttatgggaaacataaatgacagatcataatttatgggtgtcacataacaatgaattggagactttctcaaagtgacaactttttttctgcttttttctcatgtctagagctaaggtcctcaacctctgggccgtggaccagttccattccatggcttgttatgaactgggccacacaaaaggaggtgagcagcaggcaagcaagcattaccacctgagctctgcctactgtcagatcattggcagcattagattctcaaaggaacgcaaaccctattatgaattgtgcatacaagggatctagattgtgcatgcttttatgagaattgaattaatgcctgatcatctgaggtggaatggtttcatcctgaaaccattcctccaccccccaaatccgtggaaaaattgtcttccacaaaaccagttcctggtgccataaagactggggattgttggtcttcacaagaaagtctaaggctcatctatctctctttcctggtgtcccaagtttcagaatcccagttacatttttttttggcggatgggcgggggggcaacagaacttattttttaatgtttccttttctagctgttactagtttcacaaattttcaggaattattttggtgtttatttctgtattttaaaataacatagcttttcttggtttttcctgaatattcattttggagcattatttattgacttcttactgtggaaaataataattggctatctttcactttctccaaccttcatcacatgttcttatttgctcatactcccaatattattatatcctaaatttgattgattacattgtttattcattatttcagaatttatatcattccatttattaacactattcacatctaactgaggatcacttttgtcttctgaatccaaagtcttctttcttcgtgtaattcacttttcttttagtgaatgctttctttattgtattttatgtggtatttatatgatattagttatagaacaaattacagttcaaggggctcatttgacagaaagaaattcatagtaatttaaatctaattttaattttatttatctacgtaggttttagaaagatcttttaacccttgagattgaattatatattcctgaatttaaataaaccttttaaattctctaaatcttgttcagttaattgctttaaaatcaaaaggtcttaataaacaatttttcatattgggggaaaattctctttcttacatagtaactttttcgggagaatgagttgttataaaataagaatacagtgcaaattaaatcttactgtatatatcgtactactttattcttgttagtctgtggagatgacagtctttgctgtagtagagctgccagaattgtttgaaaactggatatcatattgggaaagtcctatttatttctcttaatatagtatttttatacctttattctgtgtataagtgatacttgggaagtagaagaatttaggtccttatgagaaatttgcaatctatgaaagtaagaaatatatgttaaattgtatattatatattaaattggattttcagttgactttaattatgactcccattttgcaatcatcttgtgtttgcttagcttttctgtgtctttcttttctgacatctgcttgagtgaatcattgctcaacagtacacatattggtccttgggagggcacatgcttttgttgtctgagcatgctgcctaaggatttatactggttctgggcccatggaaaaaatagaactacatggtagaataggagtatacatggcaaattttggttatttgaagattctgtggaaagctttgaaaaaaagataaatttctttttctcttactttttctccttcatccttttatctgtctttttatatatcagtttcatagggcttgttattaatagtaattttcccaatttaaataatctataacattatagaacaaatgtactattttcagttatcctgagaaccagctatggtttattctgacatatactttttgtagccccctaccatcaggcagatactttttctttcttttttttttttttaaaaaaaaaagacttttattttaggttcagggatacaagtgcctgtttataatataggtaagcttgtgtcatggggatttattgtgcagattatattaccacccaggtactaaaaaataaaccaatggttatttttatctgatcctctcccttctcccacccttcaccctccaccctctgataggccccaatgtctgtttttctcctctatgtgtccatgtgttctcatcatttagctgccactaataagtgagaacatgtggtattttgttttctgttcctgcattagtttgctaaggataatggcctccagctttatccatgttcctgcaaaggacatgatcttgttcttttttatggctgcatagtattccattgtgtatatgtaacacatttccattatccagtctgccattgatgggcatttaggttgattccatgtctttgctattgtgaatagtgctgtggggaacatacgtttgcatgtgtctttacggtagaatcatttatatggttttgggtatataccttgtaatggggtggctgggttgaattgcagttctgtttttagctctttgaggaatcgccacactgttttccacaatggttgaactaatttacacttccaccaacagtgtataagtattgccttttcaccacaatctcgccaacatctgttattttttgacgttttaataatagctgttctatctggtgtgagatggcatctcattgtggttttgatttgcatttctctaatgatcaatgatgttgagttttttttcatatgcttgttggccatatgtatatcttcttttgaaaattgtctgttcatgtcctttgcccacttttcaatggacttgcttttttttttcttgtagatttctttatgttccttatagatgctggatattagatcttggtcagatgcagagtttgcaaaaattttctcccattctggcattttctcccatgccattcccattatggcattgtcatcatgaaatctttgcctgttcctgtgtccagaatgattatctacattgtcttctaggacttttatagttttgagtttttatttaagtctttgatccatcttgggttgatttttgtatatggtctaaggaagaggtccagtttcaattatttgcttatggttagccaattccagcaccatttattgcgtagggaatccttttccccattgcctgtttttttcaggtttgttgaagataagatagttgtaggtgtgtggtcttttttcttggctgtctattctgttccattggtttatgtgtctgcttttgtaaaggtgtcatgctgttttggttactatagtcttgtagtatagattgaaattgggtaatgtgatgcctccagctttgttcttttagcttaggattgccttgactactcaagctcttttttcatttcatatgaatttttaaatagttttttctagttctgtgaagagtgtcattggtagtttgataggaacagcattgaatctgtaaattgctttggacagaatggcccttttaatgatattgattcgtcctatccatgagcatggaatgtttttccatttgtttctgtcatctctttgagcatgttttatagttctcattgtagggatctttcacctccctggttaactgtcttcctaagaatttgattctttttttggcaaatgtgaatggattgcattcctgatttggctctcaacttgacagttgttagtgtataggaatgctaatgatttttgtatgttgaatttgtatcctaagacttcactgaagttccttatcagcttaaggagtttttaggccaaaactatggtattttctagatacatattttcatgttgtctgcaaagatagtttggctttctctcttcctatctggatagcctttatttctttctctttcctgattgctctggccaggatttccagtactgtgtctgatagcagtggtgagagagggcatcttgttttgtgccagttttcaaggggaatgcatcagcttttccccattcagtatgatggcatatttcctatatgctacgggtttggctgataacaaaattgacaaatatcccttcccttatgtttcatatatcctagtggagctaataatatttgtattaaaatatatgtacaattacagaaacttatttacagatgtatataacccgcacataaattgagaattgtatactctgctttaggtaagttctattcgaactacttttcatcagaaagggacaaaaataggttagttagttggttggaattgcagcctgttacacttccgctttgtgttttatgtcagaatgttggcctgcatttaatctaggctgccctttctctttgcttttgaacattaaaagttgtaatttttaatgattttttgaatgattataataccttctttcaaatcatgaatcaattttttaatataatgaaaaagttatttaggaatattttacctaaagtattccattttcagggccaatataaaaattgttctttgcctaaaaagttgagcttattattatattttatggacaaatgtacttttaatgagatgtaattcactttctatacaattattttatattgtgtgattcaatgttttatagtatattcaccaggttgtacaatcattttctaatttcagaatatttttatcactctcaaaccacatagctcttagcagttatttctactctcccctctcacaggccctggtaaccacaaatctactttttgtctctatgtttttgcctcttctggcaatttcatataagtggaattctaaaatatatgttttctttgtcaggcttatttcacttaatataatgttttcgagattcatcagtgctgtagcatgtatcagtacttcatttctttttatggataaatacttttccattgtttggaaataccacattttgtttattcatcaactcatggaaatttatattgatttcactttttggctgttacgaattatgctgatatgagcatttgaatacaagtttttgtgtgggcataagttttcggtgcccacatttcctcaaaaagacatatagttgcagtatgacccagttatgccatagtattttccaaagtgggtgtaccagtttacattcctaccagcaatgtatcagggtttgcattcctccacatcctttccaacgcttgttactgtttgtctgttatgtcatagctatcctacatggtgtaaagtgacaaatagcttattgttttttatgaggacttatgtaacagtttaaaaatcttgtcttttaggtgctgtacttctttgcagtatacaaggactagcagttaatattgacccaatcttatatacgtggctcatctatcagcctcagaaacgaacaagtagacatatgcaacaggtaagagatttttaaataattttttctgttaacaaatatttttcttattcatttagtagaattatatatgtcttttgatggattcttttttaacaaatgtactagatttcctttgtctccccaccttacccctttcaaacaattccgttcccttatttttgtatgagaaattgcatgtcagtataaagtttctttgattattaaaggggctttctgtacaatggcttacaaaacagaaactagtttaggagtcctatttcaccagtcttcattctttcatagtgtctacatgtccattctcatggtgtgcaatacataagaattgctcagtaaatgaatgttggcttgtttgttttgttttgagacacagtttcactctgcctcccaggctgaagtgcagtggcgtgatctcggcccactccctggttcaagtgattctctcgggactacctcccgagttcaagtgattcttgtgcctcatcctcccaagtagctgggattacaggcatgtgccaccatgcccagctaatttttgtatttttagtagagacagggtttcacctgttggccaggctggtcttgaactcctgacctcaagtgatgtacccacctcagcctcccaaaatgctgggattgcaggtatgagccacagcgtctgaccagcttttatttttatctctacatttccttgtcatatttaggttttttcaacaaacatgcatcgaatacctaatcctgggattgggatggttggtgcaaaaaaggttggaatatgtgtttgtttaaaaaggtataaattagaaagtagtaagtaggcaattatagtttctagaatacttaaacataattctgacagttttattattttcgttttaaagatgaagaaactgatgcttattgagattcatttatgtatagtcacacagctttaagtaaatgacagaactaagaatttttgaggccaaattcgtgctttattgaattataatttcccatcaacttaagtataattttgcaatatcctatttggaatagttttgtatcgtttttctgaagtaacttcaagctagttgatgggagaagaatacacaattttataattatgtaagaattaaaaagtttaacaaaaaagtactaaggagcaccttttaaaggtttttcttcactttgtcctaattttatttgaaacttctgccatacctgtccccatttttccttttaatgagtagttacagaatataaggcagtatgctgtacaccatggccacagaaataaaagtcataggtgagaatatccctccctctgagagtatttagtgtatttgagaatcttaagggatatagtaatgccatttttagtaattaactatgtagatgtatgtccaggattatgtgaaaacaagaggaatagttctcacaaccagggtagtgtgtgaaaaggaggaattaacaactaagctgagtattctaggagtgagacagacagagaaggttgttttagactgaactgtttgagcaaaggcaaagaagatgcaaaagcatgacaagaaagagacttcagtgattccagaatggagtcaagtgtgttcttgtagagactaggagaaattggaaaccaatttctgaaaaaaaattttgaatttgtagtcctaggtatttgagacttcattttgaagggtaaagaggagctataggaaattggtataaacagagctggattttagaaagtttactctagcagaatatagagaatgggtgatacagaagttagactaatggcagtaaccagttgggaataattttcattgtaaattcttgattggttattctctaagtaatacagttatttccagtgtaccatagatatccctgaaggtcaagtagagtgttctagcagcttaagtaaattagacattcatttaattgataccaagcatattaaaatattttgatttttaactttttaaaaaattataacttttaaaatgaacatacaatcacgtgccccttaatgatggggatacattctgagaaatgcatcattaggcaattttgttgttgtgcaaacatcatagagtgtacttatacaaacctagatggtatgacctgctagacatctgggctataatccatctctggtatagcctattgctcctagggtacaaacctgtacagagtattactgtactgaataccttaggcaattgtaacacaaaggtaagtatttgtatatctaaacatagaaaaggtatagtaaaaatatgccattataatcttatggaaccaccatcgtgtatgcaatccattgttgactgaaacattgttatgtggcacataattataggtatatttttcgaattcagaaataatggctttatttagaagctaaactacttgcaataccaatactttgggaggcaaggtgggagaattgcttgagcccaggagttcaagaccagcctggggaacatagcgagactctgtctttacagaaaataaaaattagctctgcgtggtggtgcaggcctatagtcccagctacactggaggctaaagcaggaggattgtttgtgcctgggaggtggaggctgcagtgaacaatgatcacaccactgtactccagcctgggcaaaagggcgagaccccatctctaaaaataataagaataaaaggtaaactaacaaataccataaccccactcattcagagttacaaataatgttggagtatatgtctccatacctaaatctttgcattcatctttattgacttggaatatatttttacaagtgtaattagtagcactaggcaagtattttgcattttagaaacatattttaagacttttgttgtatcaccaaattgcttccaaaatgggtataaaatttgcattttctttttcctttttcttttttttccacacaggttcttgctctgttgcccaggctgaagtgcagtgctgtgatcacaggtcactgcagccttaacttcgtgggctcaagtgatcctcttttctaagcctcctgagtagcagggaccacaggcacccaccaccatgcctggctaattaaaaaacaattttttttgtagaggtggtgtctcactatattgccccggctcgtctaaaactcctaggttcaagtcatctacccacctaagcctcccaaagtgctgagattacaggcatgaaccccatgtccagcccagtttacattttgaacagcagttgatagcattgttattttactacagtttggcatacttaaaaatatactttaaaaaatgttcttaatctactattttactcttgaatgttccccctgccccaccccaccatggaaaatcgagagaattgcatagttgagccatatgtttccatacccaggttcaatatttattaagtcatgaccactcatccttttaaaatctgttaggtgaaaaaaaaatgccgatatacaagtattggtgaaaatgtagagaatgattactattgttgtgagtgaaaatttgataaatttgtcagtatctaataaaattgaaaattagccaacttataaccccaaacttttacttcttgatgtaggtatgctcttagagtgaaattcataaaagtaaggaatactgtgtaagcctgctgttgtgtaatcattacaataatgtgaaaatttgaaaacctaaatgaaaatttgtaagaaggttgataaagtatgaaatattcacaggatataacatttattaaaaattatacaatagaccttagtatggatgtctcaaaaattgtagttgatgcaaaagcaatttcccaatgatgtatgcaatatgagggcacttatatatatttttctaaaactgcccttaatgtgtgtctgtaagtgaatgcaggtgtaaaaattaagttgaagcatttgtactaatatcataataatggttgactctgggaggaaagggcagtaggttggcactcaaaggggattttagttttatctataatatttttttaaaaaagcaaatatgataaactgttaatagccattaattattggtcataataggtatgttgtattctttgtaaccctctagtatttttttaatttgttaaattaataattagtgaaagatggttacgttttataggatgcagctatgaaaagctttaggtattttgggattatgggacatttttgggttaaagatagaacagatctgagactagattgcaactgaaatttgagaagagctacagtaccagaaggaaaaagaatatacacagggtaataggaggttgttaaaaataaatactacttattttgatgtttttgaccaaggtagccatatttctagaatagtggaggaaatcactggtcttactccttatttggtatcacttaatgcctgacatgcagcatctttattagcagtcattcaacaaatataggtattttgtatacagctgtgtacaaggcatacaagagccttactcttgtgttagaaagtggttttgtttggccttggccttttaattcttgcctgtgtgaaaatacactcagagttgactgggcacagtggctcacgcctataatcccagcactttgggaagctgaggcaggtggatcatgaggtcaggagttaaagatcagcctggctaagatggtgaaaccctatctctaataaaaatacaaacgttagctgggcgcagtggcaggtgcctgtaatcccagctactagggaggctgaggcaggagaatcgcttgaacccggagggcagatgttgcagtgaaccaagattgcaccactgcactccagcctgggtgacagagcgagactctgtctcaaaaagaaaaaaaaaagatacactcagagctttagctgcccaaaggtattttttgtttgttgtttagtattgtcagtaccacgaaaatttattggatctataaaattttatatggatttataaaactttgtgctttcattagttgcatctttcagctattgtgcttgaatttacactgtatagcacataaattttctctagttacttattatatagttgaccctagaaacaatgcaagggctagggacaccaactccctgcttggtcaaaaacccgtgtataccttttgagtccccctaaacttagctaatagcctactgttgatcagagaccttaatgataacataaatagttaattaacacatattttatatatgtgctatatatgttattcttacattaaagtagataaaagaaaatgttattaagaaaaccataaggaagacaaaatactatataggacgaaagtagatcattcttgaaggtcttcatgttgaatagtagactgaggaggaggaagaggaggggttcgtcttgtctcagaagtggcagaggtggaagaaaatccacatgtaagtgaacttatgtggttcaaacttatattattcaagggccaagtgtatattaattttaatcctgaacttggttgtacctttttagagtttggattgtattccaggaatataaatggacaaaaattcaaaggattatggagtcactaaatattagagtataagaggttttctagtccaccccccctccttatgttttagatgaggaaatttaaatgcatcaaaacttaacaatataaggagcatatctcatctaggtcttaaaaatggtttccaatttagatttgtgtattatcagtttgactaaataccaaatataaaagcaggcactctatgttatgatgctttcgataatttatttaatcttttctcattttaaatttttttttttttttgagatggagtctcactctgttgcccaggctgtagtgcagtggcatgatctcggctcactgcaagctctgcctcctgggttcaagccattctcctgcctcagcctcccgagtagctgggactacaggcacccgccaccatgcctggctgattttttgtttttgtatttttagtagagacggggtttcaccatgttagccaggatggtctcgatctcctgaccttgtgatccgtccgcctcagcctcccaagtgctgggattacaggcgtgagccaccgcacccagcctctaatttcttttccttttttttactcagtgtgactagcaacttgtaaaataatatgcccttttccatgtttcagaacatgattgattttattacatagttatataataaacatgttttcattgaaatacttttttataatgtacattatattgagtattttaagttgggtgaggcttaaggttggatctataaaactttggttgtggtactgaagataaccttagactacactgcagcctgaccaaccgccaccagattcaccatctgatacagctgtgttacagttatcatctgttgtttccaaagctaaaatttccttctcaaactgtggctaaaacgcaacgtttgatgattgttttccacccacttcagcatttatctttgatcctatggcaaacttaaaactttttttgccaataatatgacaaaattgtattgggcatcatcatcagtaacatcagactttatttcagtgaataaagatgaaacagctgctttattgtccagctcagccctcatgcattcaatagaggatcataatattttccagctttctctaactagttatttttctgtgctttctgaatatgctatggatatcttttgtcagacaaaacgtagagattttcagtattcttcaaaaaagttggactatccatattaacatgtacataatcagtttgtaaaagtatgtttctaaaaacataaggattttttttataaggatccattttataaggataactttataaggatacttttccattttttgaaaacataattttcaaagtgaattttaattttaacttgctctttccatattattttaatacttcttactaaaacttacattttctgggtacttacaggctctttggttttcactcagaattttaatttaaaatttaagtggataagcattgctctgtgtgtgcatgtgtgtctgtgtctgtgtgtgtgtgagagagagagaaaaaaaaaagcggggctgtggggacagatgagggagggagagattgattgatttacaataatgaagtctcagccccaacttgtgaaggactgtcctcagtattgccatgtttaacctttgctgcttaagaaatagtgaaaaactaaaaactaaaaaggttttcattttgtctctttccagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacaggtatgtgtcaagtactgtaaagggactatgattgtactctacttctaagctagcaagttagcatccacaatttcatggatgctggccaaagacatgagactcattgagtggagacaaagaactttattatccacaacattagcaataatcacagtattagcatttttttgtgttagtgccctgagcccagtttccataaggtggcatgaagagggccaagaattctgaatttagggaacttgaaccttttataatggatagaaagcatgcctgccctattctccagagggaggcgctgtgtctcctttgcaagggtgtgagcccacttgccctttgcacagaagcaggatcgtatttctatcttctgagactgttcgctatgcaaatatccttaaaaacacagtagggaacaatgacaatcaccacctctacttaaaagacccatagagaattatctctcaatagtatgttccttctttaagtgaattcttgaaaacgacagtacaccttaatcatctttcctcccctttctctcatactctctgctagatcttctatgtaaatataaagtataactatccttctataaaataatttatttccttttgtgtaataaaaagaattttacatatataattcatcaatatataattaaaaaaataatttttatgattttattttgtgatttgttttttcttcttaacctctaatttttatgatgattggctacttttctttgggtaattttatgtcttttctttagctttatttcttataacgcagatattcccaaccacattgataaagattttatagtttcagtaaatcagaaccatctatcaagtctgttatgggcaagactctgttctaagtgaaattgagggcagaaatattaagaagatccctacccttaaagaatttaaaatataatcatatatgcaaggaaattcaaattagctattgtagtatttaagtcgtatttaacaaccaaaatgctaaaataaatttgtttatggtattttatacataagtattattattttgtgctttatgatttttcctaaaatatgacattaattatgtttattttgtggaatcattagtcttccacctgtccatagccacaagccttttactttgttgagattttatcaattgacaaaaatgcctgtgcctcattttgtatcacaaaaagattatatagtttgtgttgagttttgattataaaattaaatattctttcctttaaatgtcatgttaagtttaagagttagagtttaggttttacataaaggtttataattgagctgttaatttacataaaggtttataaacatcaccttttagttaagaaaataaatgtccattagtgaaaaaaaaatggtaagaattaccttacatgcatgtaaaccatatatttaaaataatggttaaggataattaacggtgacagaaaatgcttataatgtaaatgaaaatagatgatatagaactatttagaatatgcaatcacagattttgaaatgcatctgtatatgcgtggaaaagtttatatgtaaactcataccaatcacatatcaattcataaatgatatcagttgatctgataattattttgccttctttattatactttatgtttttataagaaattaataattgttagtgagggaaaataagctgaaaacataatttctcatcattaattactttataaaatatgaaaacataaacaacacattttttaaattttaaattattaatctgaactatggttcttttctttagaattaaggataattgcattttatgtctttggtgttcccccacctttagaaccatcagatatcctatagatattcttcttatagataaggacattattatttcaccaaatgtatattcttactcaagcttgcataaaaattaataggcatccaactaatgcttgtgattgccctgtttggtgactgtgagcagtcaccaaaggtaaaaggccttgagtataacatttattgtttatgaattctatttctttccctttgggtgcccactatttttaattctctggggaacttggcagtggtactcttcttgataatactctgtcctaaacattttctttacctagaattatgttttaacactttgttttatttttaattaaaggatacagtcttcttttttagaataaaaatatattttatgatttcttagagtgagtacatacatctaaatgtagttatcaatcactgttttaattattatttatattgcatcataaattataatgagtttgttaaggtattcatagtcttttgcacatctgcctaccttttttggttgttggtttttgtttgttttttaaccatcttagccattttcagtagcattaggtataaatcagtagcattaggtataatcacattgttgtaaaatacacattttattttttaactacatgttacagtggagaaatgttaatgttcattttatttctgagttcttattaaaattattttttaaatttatatcatcacagcctatggtccaatgttgattttaagttcatccccaacaagttatatatagtggttttgacacatgaatacaaagacctgctgatactgcactgggtttgattttgctttttaattattcagttagaagcagaccttttcctcttccaaactcagccaatgttaagtggctggctacagggggacctgtgcttgatggctcggaatgtgttaacagcagaatgccactatttcaatgatatagtcatgtagggcagactgagccagaataaaaacttgctgttccacatgaagataatctattatcacagaattctaaataatcttccagagaatctgtatatccttcaaaacaatgaaacccctaagagctatgccatttgtttaccctaggttttgaaatgttataaaccttaatttggaattcttgatgaaaatgtctgtgatggagatgaaaacttaacaagcagaatactccataaatgatacttaagagatataaaccattttatcttacaagtttatatattacttctcacgtcaacataataaatacagttaaaataatagaagccttttaaatttaagacaccttgactattgctaagatagtaataaatgaagacatgtgataatgatgtagatttggtagataatactataaattcaaaatatagaactttagcttctggccatgatagagtaacagggtttagatttatattcctgctgtaaacaactaacaaactggataaaatatatggggaaaattccccagtttctggacattggacaataggcagtgcaggagtgtgattcctcatagaaaggaaacaaaggtgagtcctaggatttccctagctttctgcctcaaggcaagtttctgaatacagggcagaataggacatctcaaactgagctcagcagtctttctgagttgtagagacaggaactgaagttaagggaggcagagatgactagaaattatggaataaaattccagagatgaagaaagctatgcagagaaagagcccctgggagcaacaatagagttcttgagagtttgctgaatagcaagacatgaatgcatggcgatgagacctcacagggtttggcaaggaataacctcggagctacgatcttaatgattcccatccttacacagggtggaaggcattgaagttcctactgtccatcatatataattctcattggttatttaggacattcagtggagaccagaaggtctaggcctcagtagtggggctaaactatctatagagtaaaggctaccctagactcaccttaaacaagcttgtaaatcagcctctgaaggaaacaaaatagtgagtaactgttactgttaaaaggaatacaatactattgtagcccaacatcattaaaaggaatacaataagatggagacatacaacaacttaaatataacagttgcaaacattcaataaaaaattactagaggtgcaaaggagtgagaactacaaacaggagagaaactagccaatagaaataggctgagaaatgacaccaatgatagaattagcaggtatattaaatacctatatgttaaaacaggtgtcataactacgttgaggtatttacaagaagttggacacattgaggagagaaattgaaaatatataaagagccaaactcaattctacagatgaaaaataaaatatctgaaataaaaaaatttagtggaattagatgttgagtagtagatattgcaagaaaaagaaattaattaacttgaagacatagtgatggaaacatgccaaaatgaagcacaaagagaataaaggaaaataaatgtacagagccttatcgaaccgtgggatgataattaattatggttgtgagggtagggctcactgaaagttcacatttgaccagatacttgaagcaggagagggagtgagccatgtagacatctgtggataaatgatttggaattatctatgtatctgtatctatatgtatacatatatatatatttagaaataaatgatacactgtaaccctttcattttataattaagactattgagtcacaaagaggtcaagcaacttatccaaagttaaaaagatatttattgagactttttaaaaattgaaattgccagactataggaagagatcaagcaacttatccgaggttaaaaagatatttaatgagactttttaaaaattgaaactgccagagtataggcactttgcgattatttccttcttccactctgaatatttcctgctttctttctttcatggcattggcagtcctgcaaatcaggtctgtgcaaattttgtcatctactatttcatctctaatacctaatatatagccagccaacttcagtgtgtttttttttgctaaggaattactctaaatttgcagccctgtcccgtggcactaagatagtgaaagattttgcatcagagttaccaagatagatactactgggaagcaccttttatgatcgtgtttcataatggcattgatggttccacctttctttatttgagtgccacttcactgatgcacagttaagttcctggatgagactcaaaagtgaaacactactgttggtatatattttttggccttgatatatccttaaatatattccagaatactaaggcttctaccaaaatgaaaaaaaaaatgatccttcagatgtttccatttttatcaggcatatggaaaatctatcttttatgcctaggtctccaagagaagtaaatatgaaaaatcttgaaatcttaaaaagtacattgtttatattacagataataaaaggctttagattattgttacttgtttttaaagaatctgtctttggagaatcatctttggttattgagtagaatatttcttctttatttatttatttattttttgagacggagtctcactctgtcgcccaggctggagtgcagtgacgtgatcttggctcactgcaacctccacctcctgagttcaaaagattctcctgcctcagcctcttgagtagctgggactacaggcacgtgccacatgcccagctaatttttgtatttttagtagagacggggtttcaccgtgttggccaggatggtctcgatctcttgacctcgtgatctgcccgcctcggcgttccaaagtgctgggattacaggtgtgagccaccacatctggcctgagtagaatatttctaattacatttttttgctgacctcatttcaaggtgtaatattttaaatttatgccgaagtttaataatatattgtttaggcttaagtttggctgaaaatatcagactactctaaataacagtgctttaaacaagatccaattttgtctctcattagaaagtttaagcacgcaccctaaagctattatgatctttcaagatcaggaagctttttattctactttgagtggccttcattgccaggctttcctcatggttcatgatggtggcttcagcagttaatcaagtctgcatttcagtgagcataaatgagtacagtgaaagaaaaaggtgctttctgcctcattaagcactacccagaagttgtacaccccattttgtttatatactcttgactagaagctagttacatggtcctgtctaactgcataagaggtcttgcaaatgtagtatgtaatctttaaggccatgtacctggctacaacttgtatgttctaactaagaaagaaagggagagtggatagtagagattatttagctgcttccaccatagtaacttaaaatggaaaatcaaaagctgaattttggaaaaaaatagagaataaaaatattttccttttagtatgcacatcacaagacaaagctggttaaaaaaatgtttttagtgttgcttagatatttcacagtaagagatatagacttgggagtcatcaacatatggatcatagtggaagccacagagtggttgagatttctcaggagaccatacagagcaggatgagaagagagtgcaaaattacattcaaaggaactctttaatggtagagtaaggagaaggagccaatggagggagttcagaagcatgattatgagaagtaggcaacaaagctacatgtatatgtgtgacacaattccaaagagttgcaagaagaaggtgcatgacatgctgtagaatcatcaagaacaatgaggctgaaaaataggctgttagtctgtggtcagttggccagaggacctttagttgttaaggaatggatgtgaattgaagaaggagggacaacctatgtacaccaatcattcaagaaatttgattatatagtcacttggggtatgtgtatagcaatagagatgtaaagagacaaggagacaaaattggagataccacaaaggctgaggataatttatacagtgagatcataggtaagcaagatataaaacccatgcacagatgtgagacttaacgatcaggaaaaatcatttcttctttaagacagaggtaagaagataagactatgtatcattatatattcatttagttatttttctttccacaaacaagtatttaggtgggacaagtattttttttttttttgcactgttttagagaatctaagagatcaaaaaatgtataattttctcatgacaagcctcctatttttctcatacagggaaccagtttttcaggttaactttggaatgccctggctgagaagaggggttcattcagatggttagcgggccctaaaattttattttttctttacaaatgtcatttgaaaatattaaagcatgaaggtagacactattatataatatgcaatttattttatcagggataaaagatggttttaaaaaattttactactttggaacagaaaaaggttgaaaataaaataaagtctatctaatgaagtacatctaaagtaaaataacttgaaaatgtaattcagaaagtcgtcagagaatttaatgaaaatatatgtttactaagttgttttgtacattgtaagaaaaattatttttatttctaaatcaaaattcaagggaaaaaagtattagtctgcagagcttaaaatgatatacaaagttaaaattatttcataatttgtttctgcactattctaggtaatcagcataatttataattagacaatatttctaagattaattttctaaaggacttcaacagatgctagatgattatttgatatgttacccatattgtagatgattgtagccgtagacttcatttccttaactctgtttttttaatgtttcatgttttatgaaggtaatagtttatgaagatgataaatatgaattatctctgatgatagctatcactttcataaacatgaagcatccttcggtcatctcatgacaatcttttatagccgtatctatcaaatgcattacttagttgacatttaccacatatttgaatttcttgcattgctagtgttcatatgaaaactcctgaagtgaatcattagctcataaagagatgtaattacactttatttagtatgtctccatgtgtgccgtgcggagtattttatcattggtatttgatgattaattctaacaaagtgttcagtttgttaagcagactgggtttatctatttttatttttaaatatactacactttatttaacatacatataatgtcctatcttgttggatcgttttcttgagagagtagcaattattccatatttaatttttaaaaaattcttggtccttacatctttggctcactttttatttttctaggattgtaaagcagatttatttgtgtatggtttcttctaatgtgttcaagttttgctttctatttttactttgaaggtagagcatagacttcattaaattttctcagaagagaaagctttagaaggtaaattatgttgaaaaattgcttctacttctgtaccctattggagttatttgacttccattactgttagcactacctcactcccgtcccacttttgaacatgctggcccaaacttggaacaaaacaacaaaaagagggagggggaaataagaacccccatccccaccccaaaacatggtttcttggtttccttcagcacagctgaggcaggctaacattttgttaaaagcgttactgaatactaagaaggaataaattagaacaaatacagaaaacataaactatttaaaaatagttaaccctaaaatagtagtcttcaattgtttttcttagtgcacgcctaccagtaattttttgagcaagcatccatagtagttattgatttatacattaactatatgtatcactatttaatgtaataaagcgtgtaaggttattttaattttattattatttaagttgtactattcagatggaattttaatacatcagtaatgtttcagtgggtataatattgcatggtattacttttttttgtttttgtttttgttttgtggcggagtctcgctctgtcatccaggctggagtgcagtgcgcaatctcagctcactacaacctccacatcccgagttcaagcaatcctcctgcctcagcctcccaagtagctgggattacaggtgcccaccaccacacgtggctactttttgtgttttttagtagagacagggtttcaccatgttggccaggctggtctcgaactcctgacctcaagtgatccgtccatctcggcctcccaaagtgcttgtattacaggcgttagccattgtacccagcctgtatggtattactttttaaatatttgtttaatactttgttataacaacttataagtttaatttttaattaagtttattccaattgttggttttaatggctgacataattggaaagctgcctcactgagatacatcatattgaagagatgaaaagggcatcattgactgtactcaggatacttatttttcagtcccatctattttgcaaaggtttgctgacataaggctagtaaattttcatcttccttgtaaaatgagttatttcaatttaatgggatagtattgccttttttattcaaataaattagttttgtctttaatccatatttttgagtgtgttttacaggaatatttttaaagtgtgtatacaggttatgagtattaatttagttaaaataataaaatttttaaacctgattaactgtacatggtaaattgtaatatgccacaattaactgaaaacaaatgaaggattgaagagcccttggcaattctttcttgttgttgagtgttcctgttcctttgtatacttaacatagtgttatctgtggccttctgacatgaggaaggactccaatgatagtctactgtattaaatattaataaactatggctgggcacagtggctcacacctgtaatcccagcactttgggaggccaaggtgggcggatcacctgaggtcaagagtttgagaccagcctggccaacatggtgaaaccctgtctctactaaaagcacaaaaattaactgggtgtggtgacgcgtgcctgcagtcccagctactcgggaggctgaggcaggagaattgcttgaacctgggaggtggaggttgcagtgagccgagatcgcgccactgcacccaacctgggctacagagcgagactccatctctaaatacataaataaataaataaatgtgtttctcatttttagatgaaagttagtataagtggatattctcatgttggccaggctagtctcaaactcctggactcaggccaggaacaccctatgggtgttcttgtagctttgtgcaccacatattttggagaatactgttgtgttggaatgttattatctgaaagtttagcattacctagagaaaacctctcatgtaaagttcagatatgattatcctgtggtgcagattcactgtgcagtggttaccaacttgtccagtgagacagaacacactcacatgcagtgagttacatgaagcagatttatgactatgctcacaggcatcaagggacaatagaagcctaggattcagtgtgatttgtccccttcatgtcccccagactccagaaaggtgctcaggttaaatggtgtctcatctgtgtatgccgcacttgcactacacctgagggtccctggaagacatctctctctgggttttatattccatggtgatatgacttgctggctaaagcattacagtgtactgtttctggtcgggactggaacagaacttgagctgttttggtcagtcccttcctatcttaagatgttgtgttgtacaattattcttaagaactacaagtgaaaaaaggaggagaactgggtggtccaaggccaccagagcactgtcctgcagatcccaaggagccaatttaaactaagaaaggtattggctgagatagtgaaagaagtctttcctccttctgatcagaggagtaaaaagaaaaaaaaaaatcaatagcatcttcaaatctgctggcttaggcagataatcagtgggataatgaccagtgaatatactaatagaaggactgagagtcaggtgagctaggaaggcaatgaagttgaacagctcttgaagaagtaagcctgagaaaggagggaaataagtctcatgatatgcttaaagcattgtgggatctatgcagtctatgcaatgatgttgctagggcagggcacatacaactactaaccaattgcctggtattccccaaattgataggtgatttctttactagcgaataaacattcctaaattaaattagaaaggactcttcaattgcaagagacaggaactatattcaaatgattttcagtttgaaaaccagttgtggcagactacttattgaatcccataaccaaaacggtaaaggcaaagatggatcttttcttcggaatgacttagaaccagagattccacattatcaggatgccatcttttcatgttggtttaaccttctcttactgaacacagatttcttgacagttttgtacatggctggggtacctctgaactcacatacttaattctctatgatcaaagaaaaacaggtcttatccagtgcctattgaaaatgtaattgaagcactttaagaggtcgaggtgggcagatcacctgaggccaggagttcaagaccagcctggccaacatggtgaaaccccgtctctactaaaaatacaaaaattagccaggtgttgtggcacatgcctgtagtcccagctaatcaggaagctgaggcaggagaatcgctcgaacccgggtggcagaggttgtagtgagccgagattgcgtcactgcactccaacctgggtgacagagcaagactctgtctcaaaaaaaaaaaaaaaaaaatgtaattgaagaggattttgcttgactgtcttaaatcatgtgccgacctcttggacagtcactatggtcaggaaggttaggtactatgattggcccagtggcagcccaggttgggtcatgtattcacccctgtgttctggggcatgagatataatgccagaaaaaatgcaagaatagtagaaacatggctcatgaggttaactccagctattccagtttgtacgtactaattttttattttacaattagtcacagcaggtttaaaacacattactgttttgataggaagatggtaaattgattatgaaggtattagtcacatgaactagggaacgggggaaaaatctggaaggaaaagacatgagatgcataagacagattgcagactttacaacaggctttgttttagtttttttaaacacagggtttattcaactgagggaaaggaattacgatatgtttttgttgtgtgcagttttgaacaatacagttttgcttagcacaatgtattaatttttcaacttcatctgtttcattacaaaggttttttcccaaggagccattaatttgaattatcataatatgtgatttgaactgtaatgtcacttaattttaaagttctttgagaacacattgcaatgttaatatgtgaacgtttttcaaatatagagttctttggaaataagtgtaagttattctagtttttacacagactggcaagaattcagcaaaaattcaaccaatttttttttacagtcttttcacccccttttagtagtcagaacaagattatagtttccagatgaaattctgaatgtcacatagtgatgacatacattttcctggttggctcagcatgagatgcaattttgtatgccatgtcacgctgacttgcagaatccaaaagctgttatttcccaaggggctttcaagagtgatagtattaaatgcaggtttattttgatgaaaagtctcatgcattattgcagttctgtggcaagtttcttaaagctttgaatattgtctaacttgtagaaattttaaaaatagtactacataaaggtcactttctcttcaagttatttaaatttatattgccaaatacagttgccaaaaataatgatgagtgtaaaatataaatcaagaattaggaaggtatagtatataaaccagtagcttagggaccaaaacacctaagtttttatcttaccctaccccatgttaagctaacatcacacggtcttgtcttcttcatttataaaatgatgataagtttacccagcaatacctcaagtaaagtaagatatgtgaaagttctttaaaatgataaaacacaattcagaaggtgaagatcatatttttgatgtttgaattttaaagggaaagctgtagacttcaagcatggtgaagcttattttgactaataagtttctagccttgtggtaaaattttattctttcttttttcctttggatcttaatcatctacaagttgccttaaatctcagtgtatcagtacagatgcctacataatgaaatttatttcacactgatgatctgccttcttttttagacttgtctaactgacctgctctgttataccagtcttatttttttttctcttttttaaaggtgcctcatatccaactgcctacacatctctacttaggtattatatggggtgctcaagcctaacatgtcttgtttcatctgccttcctaaatttatacaactgtgtacctttccccgaaccttcattcaccatgatgctcaaggctgagacctaggattcatccttagtgtctccctttcctgtccattccacttccaagttgtatcttgaatctttttgtctgttcgtatgccacaacaaatggagccacatcattttttgtacagagtaatgtaagtatatgctaactagtcttactggtgccatttggtattatattatcctctgatctcagttacctcaattcattgttcacatggcagcaagagtcatcttattaaaaacctaaattagatcatgtctctccctgcttaatcgcagtagttgcttcctattgcacttaagatataacccagacttcttaccatgctctacacagttgaatcttatctaacctccattaggttctcccatggcatctttgtcatttttccttacatggatcctgtttcattttcttatatacttcatccttttttttcttttttttttttccttgagatggagtcttgctctgtcgcccaggctggagtgtagtggcgtgatcttggctcactgcaacttcccacctcccagtttcaagcgattctcctgcctcagcctcctgagtagctgggactacaggcacccaccaccaacaccagttaatttttgtatttttagtagagatggtgtttcaccatattggccaggctggtatcgaactcctgaccttgtaatccacccaactcagcctcccaaagtgcttggattacaggcgtgagccaccatgcccagccgctatatacttttcatactgcaggtcttagtttagatgatcaataaaaaaacttctgtattccctaaaataggtctgtaccactcacccaggattctttaacacccctttctatccttagaacacttatcatgtatcctgttcttgttttttttttttttattctctccttctctagaatatatctcaagggctatatgtgaattgttcatttttgtattcccagagtctaatagccatttctggtattgagcaaatatgtattaaatacttgttgcatgaatgaattaacctttttgtttctcgttatttttattcagagatgtaaaactctcattccttaatcttttaaacccctgttctttaattgatttaagttgatgtcctataacttttcatatctgttctggtttctcacagatatttatcaaatattcagaaggagttagcagctcatggcacaatttcacttcgtgtgcataatcttccagtgtattcctgctacatcagaaatttagatatattttaaaatgttgaattattataagaatgatccaagtacaatgcaggatattaagataaaattttacctctagtcagtgttctccactctgtgctagtgggttggggaattgcaggtaatgtatgacatggcttctgttatgatgaactttaggttatatctggagagagaaaagtaacgtacaaatagtagactttagagaactgaggaaaattgagtggaaggaatcattactatagattttaggaattagaaaagttttcattgagaagaccttaggataggtgttagatagggtttgtaacaatcatgaaggtgctttcatttggatgggaacagcagagagaagacactgattggagtaaagagtctttagtggaaacagtggaaaataaagttgaacagagtttcagagaatcaagaccaacttatacagggctttgaaaaccatatagagaactttgactttctaccagagattcattcttaagtagtatcctatagctgagaattgtctgtaggatggaactaaaggaggaagacccttttcagaactgtgagtaaatctttatagtgatgaacattttcaacaaattggtagccagggaaacaaagaagaaagtacagatttaggttatttctgaaactaaaaattgactttttttcttaccctttaaaaaaggtatatgtaaatttatgtttatttcttttgagagagtcccaagtcatttttaggatcatgaatgataatagcttctttttcatagtcatacatatgtggtttagaataaagtgagaggtcatcagtgcttctacaattattgtacgttctacattatgatacaattttttgctatccatctatttctctccttataatgagagcccctcagagatgtgaccccagtctctttgtttctccatgacctagcacaagtaggcactcagttatacttattgaattgaactaagcgacttttccatagctcataagtcttggaagaggccagcattttcctttatctcattttcttttctttttttttgcctattaattaattagtttatttttttatttttttattatactttaagttctagggtacatgtgcacaacgtgcaggtttgttacatatgtatacatgtgccatgttggtgtgctgcacccattaacttatctcattttcaagtgttttccaagccacatcaacagaatgtaagaatgcaatgtaataagattcagaagttggcatctgtttgactttatttctgctgtgctgctgaaattttaaaaatctttttgtgatcttctaaagacatgaggaaatgggggattgagagaaaggtgatgaggatgagattcccttctgctatgttcttcaacctgtattcttgccaaaattcttctcttcatggactagcaaggaggacaatatggctggtgcagagagagcactgggaagagggatgtaagaggaagtaaaaaaagacaagaggaagccagatcctgtagggacttacaaatcattgtaacgactttgactaataaaagtgagcaagatgggatggcatttaagggttttgagtagaggcatgatataaccttttttggctattttaccaatattaatcttgatgctgtattgagaatgcactgtagggagaaaagtgtagaaggagataagccgggtgccatatggctcttggccatagtgtatatctataatcatggtaactttgccaggtagtattactagaggatgcaaggtcaaattcaggatctattttaagatagagccaacagattatagtaattttcaggatgtatggtgtaacagagaagggtcatggttttgtttgtttgttcgtttgtttttgcagccagaaaggtggattaggtatttattgaaacttggaggactataagatgaagagcataggggcttttgagaaagagactcaagagttttgctttggctatgttaaatttgaaattcctattaactatccaaatggagatgttcagtacgcagttggataaatagtctggagcttacaggatagatccagacaattccctggaaatagaatcctcatagaggatacttaaagccatgacattgagtgagatcctctaagaagaaagtgtttgtagagaagagaaatggcccaagtactgaacccttggacatgccagcattttgtggtctggagaatgaagaattaccaagaaaactgagaaagagctacaactgaggtagaatgggaacatggagatggtagtgttcagaaagaagtgaagactgtgttttaaggatgtggaaatgatcaactttttcagattcctctaatagttcagtgttaaacaatggctctaaaaaactaccacagaaattttagtgactcaacatagcagaattcatttctagttctaggaaagtccattactgagtccacagtatgatagctcttctccaagcagtgaatcagccaccttccatttagccactctgaggatccttagggcctcagattcagaaaagagttttaggaagataaagattttgctgatgacatatcatgagttctagatggcagaatggaggagattgcagtgtgtggagtgagagatgaggtcaggtggggattgcacaggtctgtttagtgatgagaatctgggtgatgaggggtattgttagaattttgggtttttcctgatggctgatgtaaacagaatacaaatggcataaaggaattagtactggggtttctaatgcagaattaggtggcaaggctgtgagtattggggctggagggatgtggtctttaatccctctgggattacaggcatgagccaccatgcccagcctgaaacaagtttgaagatatttaaatcatacattcagtaaatatgtacaattgtatacttagtggattttttaaatatttgcaattagatatgtcaaattaaattaccaaaaaataatcaaatttttaggcctggggtttttctttggattgcaaagacccccacaaaataaccaaggatcataactttctttttccgctctccacttacaggaaaaacaattaaatgcagatcaagtaaacatatttaatggatttatttaagttaacatccggactacatgctggcgtcataatagattcaacttacaattcttgtatcaggaatcaaataagatgagaagagttttgagtattagcaaaacaactcctagttggtctctattttcactctcttcctcttccaattatgtatcctttgtgttaatataagaattttcacttcataactcaggaatggaaaaccaaatactatatattctcacttataagtttgagctaagctatgggtatgcaaaggcatacagagtggtataatggacatgagactaaaaaggtgggatgggggaatacttgggtgacaggtgcactaaaatttcagatttcaccactctaccatttatctctgtaaccaaaaaccaactgtatctctaaagctattgaaaaatttaaaaatttgttaaaaataaaaagaactttcacttctaaaactcaaattttattacacttaattgtttaacagttttcactatctcttggtaccttcaggatgaacttcatgtttctttgcaagatatttaagaccctgcacaagtaggccttatcttgtctttctggccttacctctagtataccagttgcattttttgtgtggtatacttcactcacactaaactacttacaatgcactttgtgaatctgtgcctttgtgcatcttctttctgtctgctagtccttctgtctttgatttaagaattctttctcaaacaaactccatgttacctcctttgtggaatctttcctgccaatatttgagtgaattaattcaatcttgctgtgttaccagaattatttatttatttatttatttatttatttatttatttattattataatttaagttctgggatacatgtgtagaacatgaatgtttgttacataggtatacacgtgccatggtggtttgctgcacccatctacccgtcatctacattaggtatttctcaaaatgttatccctcccctagcctcccaccccacgatgggggccagtgtgtgatgttcccctcccagtgtccatgtgttcttgttgttcaactcccacttacaagtgagatcatgtggtgtttggttttctgttcttgtgttagtttgctgagaatgatggtttccagcttcatccatgtccctgcaaaggacataaactcatccttttttatggctgcatagtaatccatggtgtatatgtgccacattttcttaatccagtctatcattgatgggcgtttgggttggttccaagtctttgctgttgtgaatagtgttgcaataaacatacgtgtgcatgtgtctttatactagaatgatttataatcctttgggtatatacctggtagtgggattgctggatcaaatggtatttctggttctagatccttgaggaattgccacactgtcttccacaacggttgaactaatttgcactcccatcaatggtgtaaagtgttcctattctctgcatcctctccagcatctgttgtttcctgactttttaataatcgccattctaaccggcatgagatggtatctcattgtggttttgatttgcatttctctaatgaccagtgatgatgagcttttattcatatgattgtaggccgcataaatgtcttcttttgagaagtgtctgttcatatcctttgcccactttttgatggggttgtttgttttcttcttgtaaatttgtttaagttctttgtaaattctggatattagccctttgtcatatggatagattgcaaaaagtttctcccattctgcatattgcctgttcactccgatgatagtttcttttgctgtgcagaagctctttagtttatttagatcccatttgtcaattttggtttttgttgccgttgcttttggtgttttagttatgaagtctttgcccatgcctatgtcctgaatggtactgcctccgttttcttctagggtttttatggttttcgtcttacatttaaggttttaatccatcttgagttaatttttgtataaggtgtaaagaagggcccagtttcagttttctgcatatggctagccagttttcccaacactgtttattaaatggggaattctttctccattgcttttttttcaggtttgtcaaagatcagatggttgtagatgtgtggtgttatttctgctctgttccattggtctatatatcagttttggtaccagcaccatgctgtttggttactgtagccttgtaggatagtttgaattcaagtagtgtgatgcctccagctttgttctttttgcttaggattgtcttggctatgcgggctcttttgcagttccatatgaaatttaaagtagtttttttataattctttgaagaaagtcaatggtagcttgatggggatagcactgaatgtataaattactttgggcagttgaccatttttgtgatattgattcctcctatccatgagtatggaatgtttttccatttgtatggaatgtttttccatttgtatgtgtcctctcttatttcgttgagcagtggtttgtagttctccttgaagaggtccttcacatcccttgtaagttgtattcctaggtattttattctcttagtatcaattgtgaatgggaattcccgcatgatttggctctctgtttgtctgttattggtgtataggaatgcttgtgatttttgcacattgattttgtatcctgagactttgttgaagttgcttatcagcttaaggaggtttttggctaagctggtggggttttctaaatatacaatcatgtcatctgcaaacagagacaatttgacttcctgtcttcctacatgaataccctttatttctttctcatgcctgattgccctggccaaaacttccaatactatgtggaataggagtggtaagagtgggcatccttgtcttttgctggttttcaaagggaatgcttccagcttttgcccttccagtatgatattgactgtgggtttgtcataaatagctcttattattttgagatacattccatcaatacctagtttattgagagtttttagcatgaaggggtgttgaattttattgaagtcctttgctgcacctattgagataatcatgtggttttgtcattggttctgtttgtgtgttattgatttgcgtatgttgaaccagccttgcattccaggggtgaagccaacttgaccatggtgtataagctttttgatgtgctgctggatttggtttgccagtattttactgaggatttttgcattgatgttcatcagggatattggcctgaaattttctttttttgttgtgtctctgtaggttttgatatcaggaagatgctggcctcataaaatgagttaggaaggagtccctctttttatattgtttggaatagtttcagaaggaatagtaccagctcctctttgtacctctggtagaattcgtctttgaatccatagggtcctgggtttttttttgttggtaggctattaattactgcctcaatttcagaacttattattggtctattcagggattcaacttcttcctggtttactcttgggagggtgtatatgtccacaaatttgtccatttcttctagattttctagtttatttgcatagaggtgtttatagtattctctgatggtagtttgtatttctgtgggatcagtggtgatctcccctttatcattttttattgtgtctatttgtttcttctctcttagttatttcttgtcttctgctggcttctgaatttgtttgctgttgtttctctagttcttttaattgtgatgttaggatatttattttcgatcttttctgctttctcctgtgggcatttagtgctataaatttccctctaaacactgctttagctgtatccccgagattctggtacattgtgtcttagttctcattggtttcaaagaacttatttatttctgccttaattttattatttacccagtagtcattcaggagcaggttgttcagtttccatatagctgtgtggttgtgagtgactttcttaatcttgagttctaattttattgcactgtggtctgagagactgttatgatttccattcttttgcatttgctgaggagtgttttacacccagttatgtggccaattttagaataagtgtgatgtggtgctgaaaagaatgtatattctgttgatttggggtggagagttctgtcaatgtctattaggtctgcttggtccagagctgagttcaagtcctgaatatccttgttaattttctgtctcattgatctgtctaacattgacaatggggtgttaaagtgtcccactattattgtgtgggagtctaagtctctttgtatgtctctaagaactttgtatgaatctgggtgctcctgtattgggtgcatatatatttaggatagttagcttgatccctttatcattatgtaatgcccttctttgtctttttgatctttgttggtttaaagtctgttttatcagagactaggattgcaacccctgctttttttttttttttgctttccatttgcttggtagatcttcctccatccctttattttgagcttatgtgtgtctttggacatgagatgggtctcttgaatacagcacactgatgggtcttgactctgtatcccatttgccagtctatatcttttaattgtggcatttagcccatttacatttaaggttaatattgttatgtgtgaatttgatcctgtcatcatgatgctagctggttattttgcccattagttgatgcagtttcttcatagtgtcaatggtctttacaatttggtatgtttttgcagtggctggtactggtttttcctttttatgttttatgcttcgttcagaagctcttgtaagtcaggcccagtggtggcaaaatttctcagcatttcctttctgtaaaggattttatttctccttcgcttatgaagtttactttggctggatatgaaattttgggttgaaaattcttttctttgagaatgtcgaatattggcccccattctcttctggcttgtacggtttctgccaagagatccgatgttagtctgatgggtttccctttgtgggtaacccgaactttctctctggcttcccttaacattttttccttcatttcaaccatcattatgtgtcttgggtttgctcttctcaaggagtatctttgtgatgttctctgtatttcctgcatttgaatgttggcttgttttgctaggttgaagaagttctcctggataatatcctgaagactattttccaacttggttccattttccaggtcactttcaggtacaccaatcaaatgtatgtttggtcttttcacatagtcccatatttcttggaggctttattcattccttttcattcttttttctctaatcttgtcttcacactttatttcattaagttgatcttcaatctctgatatcctttcttctgcttgattgatttggctattgacacttgtgtatgcttctcaaagttctcgtgctgtgtttttcatctccatctccatcaggtcatttatgttcttctctaaactggatattctagttagcaattcctctaaccctttttcccggttcttagcttccttgcatttggttagaacatgctcctttagctcggaggagtttgttattacccaccttccgaagcctgcctctatcaatttgtcaaactcattctccatccagttttgtttccttgctgcaaggagttgtgatcctttggataagaggcattctggattttgtaatttacagcctttttaggctggtttttccatagtcttcatggatttatctacctttggtctttgatgttggtgacctttagatggggtttctgtgtcaatgtcctttttgttgatgttcatgctattcctttctgtttgatagttttccttataacagtcaggctgctctgctgcaggtctgctggagtttgctggaggttcactccagaacctgtttgcctgggtatcaccagcagaggctgcagaacagcaaagattgctgcctgttccttcctctggaagcttcatcccagaggggcacccaccagatgccagctggagctctcctgtatgtggtgtctgtcgacccttgctaggaggtgtctcccagtcaggaagcacgggggtcggggacccacttgaggaggcagtctgccccttagcagagctcacacactgttctgggagatccactgctctcttcagagctggcaggcaggaacatttaagcctgctgatgctgcgcccacagccgcaccttcctgcaggtgctctgtcctagggagatgggagttttatctataagcccctgactggggctgctgcctttctttcagagatgctctgcacagagaggaggaatctagagaggtagtctggccacagtggctttgtggtgctgcagtgggctcttcccagttcagacttcccgatggctttgtttacactgtgtggggaaaatcacctattcaagcctcagtaagggtggatgcccccgcccccccaccaagctccagagttccagcttgacttcagactgctgtcctggcagtaagaatttcaagccagtggatcttagcttgctgggctccgtgggggtgggatctgctgagtgagaccacttgcctccctgacttcagtcccctttccaggggagcaaatggtctgtctcgctggcattccagacaccactggcatatgaaaaaaaaactcctgcagctagctcagtgtctgcccaaatggccacccagttttgtgcttgagacccagggccctgttggcataggcccctgagggaatcaccaggtctgcgggttgtgaagaccctgggaaaagcatagtatctgggtcagagtacaccgttcctcatggcacagtccctcatggcttcccttggttaggggagggcattccctgaccctttgtgcttcctgagtgaggcgatgccccaccttgcttcggctcaccctccctgggctgcatccactgcctaaccagtcccagtgagatgagctgggaatctcacttagaaatgcagaagtcacccaccttctgcactgatctcgctgggagctgcagacctgtgctgttcctattcggccatcttgccagccacctgtgttactagaattttatagtgcagtatttgtcaaaccaaatgataatcatagtatttaattaagtttatatcttatcttcatcttgtaagctcttctagggcagggattgtgtcatatttttaagcccttactgcagagccctagtatgtggtaaatggacatttaataagatttgtagttgaggatgaacaaaattactttctacttttccttcctttctggccattttttctcctttttctttccaaaaaagcgtagatgtgaacattcaaattctagtagcaatctgattaaccaaagtattttaatttatatttttataagctccctggattatatttagtttctccccgactccttataaataatgataaaagccaaagagtgggaagggtgctattgaaaggcgaacataaaatattgacaccaatttcataattctacataaaaatcagctttattgctttatagtcacactttgaataatttgttcttcttaatgaatcttagttctgagtataaaatattggaaaacagtgacagcctgttgcagatataagcaaaaaactacctctctcaacctaaaaattcttactgcttcttaaacatctcatgatatgctatctggaagtgctttagctcatttactcccctgttcaaattttttgttgttgtctatgtgatttgttttggaatttaggccaggagaaaggaattttaatggtctcagtggattaatttggtaatctatatataacttgaacattgaattctagagacattcatatctttactttgctatttataacaagacagtgttaatcagtgtgctcactctttctcactcactttctcattatctctctacttcttttctcctctttattccccttaccttactttgtttcttgtttttttttcttgacagatttcagaattcctgccttgccccatgactttccattgagatctaggtagactgtattgtttatatcctgcaaattatggaggagaaacaaacctaaatagttgacgtgattttaagatcacatatcttgaattggtagaataaaaaaagaaacctaggttttctgagtcctcccagtccatgctttcaggaaacttttatttaaatatattaatctcactggtatctgaaattctgtcacaaagagttttttgattttttgtttctattttaaatctcaaagcttcttcaaataagcataagcttcatgaggactgggattgtgtttgttttgctcaccacagaatttccagttcttaatctaagccttaagaagataataggtactccataagtagtttttgaatgatgttttttgacatgttgaaattaggggatagtttaattttccatccctccctcctttcttcttttcttcttattttttggtgagctacattttctgatttttctcctattagcccatattatttatctaataaaagtattttaaaaactataccatatagcaatagatatattgtattttaaaaactataccatatagcaatagatatatgaacagttaacactttatcatagttttctttctttctttctttctttctttctttctttctttctttctttctttctttctttcctttctttctttctctttcttttcttttcttttcttttctttcatttttttgacatggatttttgctctgtaacccaggctggagtgcattggtcccatctcagctcactgcaatctccacctcccaggttcaagtggttctcctgcctcagcctccagagtagctgggattgcaggtgtgtgccaccatgcatggctaataacactttatcttagtttttcatgaaattttcggaataaaggatgacgaaatgtgatagtgtgtatcactcttttgtcaaggcctggtttctcttctgaggaatttatccttcttccttcaaattattgcctagaaatctagagcttgcgctcttctagatggcttggtgttcaccagttagtcttaagctttctgcaaacttgtaaataaataactctgtcatcttccttcaggtcctactgaaccatttctctcgcaaaggccttgccacttttttctcattatctcagggaaccttgacttctgatatggtctggctatgtgtcttcacccaaatctcatgtggaattgtaatccccacgtgttgaaggtggggactggtgggcagtgattagatcatgggggtagtttctaaaggtttaacaacatccccctagtgctgtctcctggtagagttctcaagaaatctgatggtttaaaagtttgtggcacttcctcactccctatctctttcctgccaccatgtgaagaaggtccttgcttccccttcaccttccaccatgattgttttcctgaggcctcctagtcatgcttcctgttaatcctgtggaactgtgagtcaattaaacctcttgtctttataaattacccagtctcagttagttctttatagcagtgtgaaaacagactaacacaatttcccttatgggttatttttcatagtcatcttctctgtctgcctttgactctttaaaaaatgctgcctctccattatgatctatgatctgagtttgcaaggcttattttctagaggtttttaatttttatatttttatcttttaggtaattgaactgtggttaaggcagttgccccctagtataatactggcttggctatcagtttgatttcccatgaacagaaaggaaaaataaaaattgacaatgattttcttcttgatgactattaaaatttcaaataaaaatgaaaccacaaattataaataggtaccttacacaaaggtgatacagaatatcaaataatatgctgatagaaaaggttttaagaaggtacacatatgatttgttctctattttaaaagatatcaattgattgtttgatcgagtatttactatgcaaggcattatactactgctacatgaaataaatagataaaagaaacatgaattctcctttcagcaaaacaaacactctgttggtgtcagcactgtactgaataaagtccataaacataagttgatggttgcaagttttatgtttaaagggaaaattttaaagtaagtatcctattagaagtcatccttctttattgatttaagtactaaacctaacctactttagtgaaagcacttctttctttaaggcttttacttagcagatgatgaaaacctagaacagaaagggcttaattctaagaagtgcttactatgaaaactgaattattacagctgaacaaatgtatcttgactttttgatatgatgaagtaacgtggttactgtgagaatcttaaacttcagaatataagccatttgatatcaagtgtcagtatttggtgccattggcttatacatgttactagatatttagagttaccatttaatcattgacatcattattcagtctcccagaataagaacagagattttgatgtactgattttgagtaattttatcaggttccagttcgacttgaagaaggtaaagagatgttttcgtataaatcattgattaaaatatagatgcaaaacagtaatttaatgctgtggcttggaatttctacgtttatgatttttcatccaattctatctaattggtggcatgttaataaatatgtatataaagattatttctcattggaagaataagagtaagagaggacataaagagaatgtgtcttcagtgtctagccattagccactactctttcttgctacaccatatcactatgctcagctcctcctttggagagacacacattcaaatatttaaagttataccatgaagaatgttacgttatacagaattaagtcagaattctgccaggctctagaagaaggaccaaatctttttgggaaatcagttaccatttctcagaggaaatgacatttaaggtagaactaaaacaatgagttgattttgatagaaaaggagtacagttgtgtttcagatatagttgtcttcaggttctttacataatcaatgattagttaagttttatatctttattccttatatttatagtattttcataaactgttttcgtatacattacaacatttaaattgagtagtattcttgatactacacatatttttaactttaaggtggaagtcggaaacctgacacttagattaaattcattttccttaatcatgtgtcttgtggcacaactaaaacacaagctgactccaagtgtagtactttttccatgggacagaaatgaaggaatcatattgtaccaagttgaatggttcatccccaagatataattgttgatatgttattttaaccactgaaatttgggtctgaaaattatttatttattgtagaaaactaaaagtgtaatagatacatttgaaatgagattgcgatgttaaatttaggctttatgtagctctagtgggaatgagtaaatctgatgttttctgaactatttattatccatgatccatagtagaaattttatacatttgttgtacatttgataaaactaggagtcattgtatggggattgaataatagaaaaggcagcataacatagtggttacaaggatggaccctggaaccagtctgcttagatttacatccttgttttgccacttactagctgggtgacttgggataagttacttaacctctttgtcatcagtttccctatctaaaaatggtgataataagagtctgaaaatagtatatttcctgtcaggttgttacaagggctaaacagggtattattattattattttttgagactccatcacccaggctggagtgccgtgccattaactcagcttactgcaacctccacctcccaggctgaagagatcctcctgtctcagcctcccgagcaactgggactacaggcatgcaccaccatgcccagctaagttttgtaatattttttggtagagacaaggttttaccatgttgtccaggatgatcttgaacccctgggttcaagcaatttgcctgcctcagcctcccaaggtgctgggattacaggtgtaagccaccgtgcctggacaaacaggttaataaatttgtaaagcacttgcagcagtgcctggcttgtagtaggtgctatagaggttttgattaaataagatagatgggcgtgaagcttgacagagttttatgtagtagacctgtcttgcctttccctagctgcagaaaatattgtcttttcttttttacaaacttgactatcatcatttagaaatataatgaattgaaaactggtatatccaaaatagtgtacttttactgattatgtttttcatagctatttgaacaacacttttaagccacatgtagatttcaaagtctctaaattttttcattagatcattatatcagagaacatagtatttacaaaaaacatgtagctgttttggttagtggcgactggaaatattgcttgacggtggtttaatagtgcccatactgcttggaaatattagcatttattagatagattcattttcaaatggtaataatagtactcatatagtactaatatttttcatcggtaggtttttaaattttgaccgtgaggcttttgtgcaaacctttgctattcatggtttcaagtaattttaaaatttggtctgtattttaagctaattatttagattcctagagctatacagtaatattaggtaaccattttcttctaataattactaatgtacagaagaaaagcaagaagtccaaataagtacaaagttaattaatatacatgttttaaaaaatacaataagtaattcatttttataaaacaattctgaaacatatatagtaaagagttaaatacttaccacttccttacccatcatcatttccatttttccctcctcagaggtactctctcacaggcttacgtttttacacttctataactttttctatgtgtgggaagataaatacgtattcaaatttagtacactgtttaaaaacatatttggatgataccacacatatgtttgagttttttcacttcgtaagataccaaaaatatgcctttagtcatacctgtaattgtacctcatccttaaatggtttaattatactctttattgcaaatatttccaaattagctgtttcttttttgatggacagataaattgtttagcattttctttcctctcgtcttctctcctttcctttctttcttttttgctgttacagaaattaccactgatgctgaatatcttttataaattgtttgcatgcaccctcacaacttttactatttccatagcatattcttagaaatcggattattttatagaaaaagtatgtgtgaatttttttttttttgaaacagtctcactctgttgcccaggctggaatgcagtggggcaaacttgactcactgcagccttgacctcctgagcttaagcaattctcctgcctcagctacctgagtagctgggattacaggtgtgtgtcacaacatctagctaattttttttttttttttgtatttttagtagagaggtggttttaccatgttagccaggctggtttcgaactcctgacctacagtgatccacccacttcagcctcccaaagtgctgggattatagatgtgagccacccaccatggccggcatgtttaaatttgtagcagatataaattgccctctgttgcagttccattctatagagcatacctattttccccatatataaaacattctcacaagaggcttcaacaatgacaaatttcataggtatacaacttaactctttaacatgtttccagtataacagatgaaaagtatgtctggtttgattgcactgtggtctgagagacagtttgttataatttctgtccttttacatttgttgaggagtgctttacttccaactatgtggtcagttttggaataggtgtggtgtggtgttgaaaagaatgcatatacgttgatttggggtggagagttccttagatgtttattaggtccgcttggtgcacagctgagttcaattcctggatagctttgttaactttctgtctcgttgatctgtctaatgttgacagtggggtgttaagtcgcccattattattgtgtgggagtctaagtctctttgtaggtctctaaggacttgctttatgaatctgtgtgctcctgtattgggtgcatatatatttaggatagttagctcttattgttgaattgatccctttaccattatgtaatggccttctttgtctcttttgatctttgttggtttaaagtctgttttatcagagactaggattacaacccctgcttttttttttgttttccatttgcttggtagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatctctgggacacattcaaagcagtgtgtacagggaaattgatagcactaaatgctcacaagagaaagcaggaaagatctaaaattgacaccctaacatcacaattaaaagaactagagaagcaagagcaaacacattcaaaagctagtagaaggcaagaaataactaagatcagagcagaattgaaggaaatagagacatttcccttcaaaacgcttcaaaaaaatcaatgaatccaggagctggttttttgaaaagatcaacaaaattgatagaccaaagcaagactaatgaagaagaaaagagagaagaatcaaatagacgcaataaaaaatgacaaaggggtatcaccaccgatcccacagaaatacacactaccatcagagaataccataaacacctctatgcaaataaactagaaaatctagaagaaatggatatattcctcaacacatacacccttccaagtctaaaccaggaagaagttgcatctctgaatagaccaataacaggctctaaaattgaggcaataattaatagcttaccaaccaaaaaaagtccaggaccaggtggattcacagccaaattctacgagaggtacaaggatgagctggtaccattccttctgaaactattccaatcaatagaaaaagagggaatcctccctaactcattttgtgagtccagcatcatcctgataccaaagcctggcagagacccaacaaaaaaagagaattttagaccaatatccctgatgaacatcgatgcaaaaatcctcaataaaatactgacaaaccaaatccagcagcacatcacaaagcttatccaccatgatcaagtgggcttcatccctgggatgcaaggctggttcaacatatgcaagtcaataaacataatccagcatataaacagaaccaaagacaaaaaccacatgattatctcaatagatgcagaaaaggcctttgacaaaattcaacagcccttcatactaaaaactctcaataaattaggtattcatgggatgtatctcaaaataataagagctatttatgacaaacccacagccaatatcatactgaatgggcaaaaactggaagcattccctttgaaaactggcacaagacagggatgccctctctcaccactcctgttcaacatagtgttgggcaatcaggcaggagaaggaaataaagggtattcaattaggaaaagaggaagtcaaattgtccctgtttgcagatgacatgattggatatctagaaaaccccatcatctcagcccaaaatctccttaagctgataggcaacttcagcaaagtctcaggatacaaaataaatgtgcaaaaatcacaagcattctgttttttgttttttgtttttaattttttattatactttaagttttagggtacttgtgcacattgtgcaggttagttacatatgtatacatgtgccatgctggtgcgctgcacccactaactcgtcatctagcattaggtatatctaccaatgctatccctccccccctccccccaccccaccacagtccccagagtgtgatattccccttcctgtgtccatgtgatctcattgttcaattcccacctatgagtgagaatatcctgtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggagttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggattcttatacaccaataacagacaaacagagagtcaaatcctgaatgcactcccattcacaattgcttcaaagagaataaaatacctgggaatccaacttacaagggacgtgaaggacctcttcaaggagaactacaaaccactgctcaatgaaataaaagaggatacaaacaaatggaagaacattccatgctcatgggtaggaagaatcaaaatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtatcaggctacctgacttcaaacggtactacaaggctacagtaaccaaaacagcatggtactggtaccaaaacagagatatagagcaatggaacagaacagagccctcagaaataatgcagtgtatctacaaccatctgatctttgacaaacctgacaaaaacaagaaatggggaaacaattccccatttaataaatggtgctgggaatactggctagccatatgtagaaagctgaaactggatcccttccttacaccttatacaaaaattaattcaagatggattaaagacttacatgttagacctaaaagtataaaaaccctagaagaaatcctaggcagtaccattcaggacataggcatgggcaaggtctttatgtctaaaacaccaaaagcaatggcaacagaagccaaaagtgacaaatgggatctaattaaactaaagagcttctgcacagcaaaagaaactaccatcagagtgaacaggcaacctatagaatggaagaaaatttttgcaatctacccatctgacaaagggctaatatccagaatctacaatgaactcaaacaaatttacaagaaaaaaacaaccccatcaaaaagtgggcgaaggatatgagcagacacttctcaagagaagacatttttgcagccaaaagacacatgaaaaaatgctcatcatcactggccatcagagaaatgcaaatcaaaaccacagtgagataccatctcacaccagttagaatggtgatcattaaaaagtcaggaaacaacaggtgctggagaggatgtggagaaataacacttttacactgttggtgggagtgtaaactggttcaaccattgtggaagtcagtgtggtgattcctcagggatcaagaactagaaataccatttgacccagccatccattacttggtatatgcccaaagtattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactaacgcaaggacaaaaaaccaaacacagcatattctcactcataggtgggaattgaacaatgagaacacatggacacaggaaggggaacatcacacaccggggcctgttgtggggtgtggggagtggggagggatagcatttggagatatacctaatgttaaatgaagagttaatgggtgcagcccaccaacatggcacatatatacatatgtaacaaacctgcacgttgtgcacatgtaccctaaaacttaaagtataataaccaaaaaaaaaaaaaagaaaaagtatgtctgattgttggatatctgatgaaaaggatatctgatatcttaatttttatttctttgttagcaatgttgagcattttaaaaataagttactagccaaataactttttttctgtaaataatctattcttatcttgtctatttttttatagtcgtttatctatttgccaccttatatctttacttggatgtctaatggaaatctcagtttaagacatcccaaactaagtttcctttcttctcaaatgtgcttttcctacagctccattcttccagtctctcagtcctaataccttggaatcatctttgctttctcttgtactatacatctaatccatcagtaagtcttattggttatgtctttgaaatggatacagcattttaccacttcttgccacctcgttgcttctgctgtctcttacaacctgtcttcctttttcaacactggatacatgtagtaaatgttttgcacagtagccagagaagttctttcaaaacacatattcaacaatgtcatgactatattcagaatctgttattctgtcccagttccctcaagtaaaaaccatctccttactatgacctacatgagccctgtatgacctggtccctatatatagctctaacctcatgtcctacttttctcacccttgctcactctgctgaagccatctttgcctccatactttgcttgaaaatcccatgcatacctttaacttcagacattcgttgtttttgtttcatctgactactataatgctctgcccactgagatctgcatggatctcttccaaactggtttgctttaataaactttatttacaatttctgatattgacaatgtcataatatatgacaatataactatgagaaagaaaaagtccgttcttcatgcccttaaggtattttaaatatggtatcaatgctcatatattaaccaagttagggggagaggggaagtatgagtggatatggcaactagtcatatatcaccacattctcatagtagtgatatggtactacttattttggagagcatcctaggttcttcaaacttaatttatttaggtctgatttatttattttatgctactttataagtacctaaaatactacatataaattatgtatttgaattaacataagctgtattatataaatgtatccagttttaaatgaaactgtttagttataatacattactataaattactcaattgtttaaaataattcctgaaatctttcattatgaaaacatggttgaaatcctctaatttctttacttggaagaacaaaattttaaataatatagggagtggaatattacatttcattttattaagaaatcttccttttatgtaatcacatacctcttttggttatcatcaaaatccaccccccccccaactttttttttgttgttgttgagacagtgtctcactctgttgcccaggctgtagtgcagtggcgcaatctcagctcattgcagcaacctctgcctcccgggttcaagtgattcccctgcctcaggctcccgagtagctgggattacaggtgcctgccaccatgtctggctacttttgtagttttagtagagacggggtttcaccatgttagccaggcttgtcttgaactcctgacctcaagtgatctgcctgactcggcctcccaaagtgttaggattacaggcgtgagccaacgtgcctggccaaaatcactttttaaaattgagagattttattggtaagtttttgttatcaggaacatttacatatgggaaggataattttctatcaattttggatgaatcaagtgctttttagttgaatttctctttttcttccaagaaaagattttattgatgtattgcctttatactgaaaattggacaagttgttaagttactgcttaatgaattcttacaaagtgaatacttgcatgtaattaataaatagaacgttactatcacttcacaagtctaccttctagtcactaatccctgacaagggtgaatgctctcctgacttctaacaaattaggcctgcttatttttgaatacttgcaaaaatcagttctataagagaaaatgatgtaaaatgacaattcataatctcatataaaaattataattttaagcaaggaaagaaacaatcttgaaaatacgtttggtatgttctgtgaaattgtaagttatgtttctattaaataattagctattctcgtactcagaatcccgcccattgtcagttcctgttaaagccatgttgaatatatctgaaagctgtagaagtcctgaagaaagaatgaaggaatttattggaattgtttggaatgcagtgaagcatctcacactacaggtaaaataaaagttagaaatattatggatataatttctataatcctttttaattcccagcattgttaatattggtaagacttttctcacatgtaacaattatgtataccatctcattttcttaatttagttgaaaataattggtgtacttcacttatcctaaacataattttatgaaactcatatgaacttccttatagttataaaaatttacacattttgacatgtttcttgacttaaaaaattttagttcattctactttttgtttaagcattattttcacaattttaaattcttagtgttcatatagttccattcttatctcagaactgagataaagtctgagttggaattaaattaacatgaaagggttatctaattattttttctacataattataagttaaatatgaaaattataatagctatttccttattgttattttcctctcattgatttttactttaaaatgcacaattttatcttattgaattactttctttcaagatcatgtttaacctgactaaaatatacaattagatgcttatttgataagctaacagttataaattttagtttttgcataggattttttctctgtgataccagagacatccttatagaattttgtatgtaccagagtgtaatatcaaaggcttaagtcaaagcttttcaccttgacttaagatataaaagttgcaatagaaccttgttcccaccttactatgagaacaaggttttgtgatctgcaaaattacagctatattaagcccatagagatctgaggtcttaaattgacattaccataacagcagggtgctaaaatccaaaaaagtgacaagcaactcactttttgaaactcaacaatctcagaaaactccaagaagaatatataaaaaggaaaacatagctaagtacctagtagtcaaactactgaaaacttacggagaacgttttattttattttactttatttaaagtgggaagatctttatttatcaatattcttgtttacctgaagactatactggaagaagctgaaattataagtaaggcagacctagatatgtatttcttagcaatgtaatattggagagttttttcttgtttctgtatccacaagttggagattataatatcttcttcatgaagagggtcgaaaatatagagtgataaagtatataaaagcaactgacaaaatttattcatttattgattcattttgcaaaagttaccatactgtattcagagaacatactgaagaaaactaatgcagtcctgtcctcatgaagatcatagtttggcaaggagagatattcattaaatgattgtacttaaaataatttgactataatggtgatgatcctgcttcatgaacatacgtgtcaattaagctaaccctagaagaatcaggaaacatttgggtactcaataacacttgtgttttctttctctattccatctttctctcctgtagctgtagcttttttctaaagcagctgaaggctgcactgcccttcagcaggcagacaagaagtgatggagataacacccctgggattatcttcacccaccatgggaaatgattctgtggcattccttgtctgtcagtgtgtcctcagtagaattaagctccaggtgtccagggcttaccagcacacccattttggttactgtccttttgagaaaattttagaagtgggtagacagtaaaggcctgttatatacagattaaaaacattaagaatgactccttacatcttattagaaacaatggaggccagaagacaatagaataacacttttatgtgctgaggaaaatcagcacataacatagaattaacatagaattctctagtcagcaaagtattcataaaaatgttggccaataaatacataaagacagaacttttctctaatagaaatttactgcaagatattctgatagaagttatttaggctgaaaggaaattataacagaatcttggtttttcagaaagtaatgaagtatatcagaaagtataaatagttgtaaaacaactgaatattgaaaaaaatagtattcaaggagaaagctttagtgtgttttagtcttttggctgttagcttctttcctcttcattttccagttaactttttgtttgtttcttttttgtttttggacagaatcttactctgtcgcccaggctggagtgcagtgatgcgatctcaactcattgcaccttcgcctcccaggttcaagcaattcttctgcctcagcctccccagtagctggaattacaggcgcccaccaccacgcccagctaattattttgtatttttagtagagatggggtttcaccatgttggccaggctggtctagaatttctgacctcaggcgatctgcctgtcttgtcctcccaaaatgctgagattacaggtgtgagccactgcactcagccctagttaaatttaacattaaaaaatatatgacacttaacaaagtaaaggagttttgattaagatcaaaattcagcagttaaatgaaatttcagtaatttattcagaaaatatttatgaagtccctggtctgtcctacactccagccagcccttagtcctacagatgtgaggaaattgtctctgtgagcaactagagtgagtttggaagtgtattctttcccaggtgagcctgtggatgaaaacacagatggtcaacacttttattgcggctttttgagaccataattcaagtatttaactaagccataccaagattattgacccacagaaactgcaacaaatgtctgttgttttaggctgttacatttgtggtgatttcttatatagcatagaaaattaatatagacagatacagacacattatgcatagctatagtgtagtctgattaatcactataagaaatacatacctgccataaaaactttttagaaattcatccaaaaatatctccagtgcataaaaatactagttaatataggagccaataatcttgattttagcattcctttacatgtttcttttctgagcatgcctcttataagaaaattaagagaagaatggggggaagaaagtatggcttgtcgttcttgtgtaattaactcttagcttgcagagttatgactcttttagggatatcagctatatttcaccagtctcagctgtcatgattccttgtaatgaatatcctaataactccttgcattgacttacctgtccttctcccttagaggtaccctttgtacagtggtaacatccagcacttaatttttgttatatgttgggctatatgctgagaaaaaaaaagagacataatagttgtcatggtctagctgggaaaaggctaagtgccatggtatggagtatactgtagggagccccttagaaaacttaacgatgaaagaagagaaatgggaatgtcaagaggaatgttacttattgaaaggatgcctagggcatgtacttcctggtttgtgatgaatttagatattatcctaggtaagtatttattgctttgtagaagatctagttgacaccattgtgtggtttagaatatgatagctaccaataatatttagttgtttaaagtttactatagatctaaatgctatttcatgataatagaagtagttatattaaaaataacctcattccctcttatctaatgattgaataatgtggtataattatccttttattgatatcattttgagtagttctgtaatagggaacatgaaagatagtattggattacatgattatttgacaactctgggaaaatattccaatttaagattccaagtaatatcagaaatctttgcactatcgataaacaagtaggtacatcaatattccacaatgtaggatatactggagaatgtccttctctggccaggattaaataacaggaataagatttatttcactgcctgaaataaccaaaaaattattgaaatatataacacaaagatttcaaaccactaggcaataagccaagtagacagtgattcctcagagacttaagataaaatcagcaggacttagtaattaattgatttggggaatcaaggaacagagtctaagagatcttctagattcttgttttggtgtttgggtggtagtgatgctattaaatgaagtagcttttccaggttaggggcaaatagggattttgaatttacacatgtatttgaaatgtatgtgagacatccaggtatgtattagatatttacatctggagtttaaaaaacaggttaagagaagagatataattttaggagttatctgcagatggttttcaaaccaggagaatgggtcattcaagaaagtatgtacagttgaaagagcaatgggccaagggaataccgttttaaaagttgttagtagaagagagaatgtccttgaagaaaattatgttagtgatcagaaatggaggaggagaaaccagagagttcatgaaagcaaaaaatgcttagaattttgaggagctactggtcagcaatgtcaaattctagatgttaactatgtgctttacttgcttatttgtagtataaaatggatacattaaataatatttaaggttacttccaactctaacattattgtatgattcttttgcttattttataatgttgcagtaccttttagcttcatcactaacaaacttaatcttatatatcactttgaattaattgtaagttatgatagtgattttcctcatttttccttttttaatctctaattatggtaaaatacatataacataaaatttaccttccttactatttggaataaactatatggtttattttgtggttcctcaatttgagtaagcttattgagtatcagttaacataatcattgcagtaccaaataatacatctttatataggttatcttatatatgacctaggtacttggcttgcctcaccctagtcctggccctgtgttaaacatactatatatttaaacatttccagatgttaatgtatcatcaacactttaaaagataaaattagattctcattaaatgattacaatttagactgtgaaaatctgagttttatttattttatcttattttatttttttgagacagagtcttagttgtcgcccaggctggagtgcagtggtgtgatctcggctcactgcaagctccgcctcccaggtttatgccattctcctgcctcagcctcccgagtagctgggactacaggtgcccgccaccatgcccagctaatttttttgtatttttagtagagacggagtttcaccgtgttagccagggtggtctccatctcctgacctcgtgatccacccgcctcggcctcctaaagtgctgggattacaggcgtgagcttttatttttaaaaacgttgtccattttttaagatgttttatgagccaaaatataaaacagaaaaccctgcaagttatcatcagataaaacaggacatcataacttaaaggtttcgaatgattattcttttagtggaagtttgtgcaggtaattatgtttggaaccagaatttctgcaaagttgatgttggagccaaagttggtatttgctaaacccatattattttttacttagaatagaaacatgtatattacataaaatcattaacaatatttgctgtaacctatttgtttttcagtgtggaagaaggagtttccatacttaattataatggattattttataatattccatgtagtcttggacagtctttttttttaaaaaaaaatatatatatatatgaactttggggccaggcacggtggctcacatctgtaatcccagcactttggaagtcctcggcaggcagacgacttgaggttaggagttcaagaccagcatggctaacatggtgaaatcccgtgtctactaaaaatacaaaaattagctgggcttggtggtgcccacctgtagtcccacctagtctggaggccgaagcaggagaatcgcttgaacctgggtggtggaggttgcagggagccgagattgcgccactgcactccagcctgggtgacagagcaaaactctgtctcaaaaataaaaattaaaagaataaaaatatataaactttgggggccttttaacaatagattagcataagttcaccggttctttccaagttttctatacctgctcattaacaaagattctattaaagctatgtttttattccagaagcacataattggcaatagtatgtagctgataaaatagaaatgtgctggctagaatttactcctttctaggagaacatttctctgcttattgccagacttagctttttttttggtcatttacatcgaagttcatcttgctgtcctatgacatgtactagcattttcttttcctctttttttttttttttttttgtactctctgagtttttctgagtggactgaagtcttctgagtttaatggcatttttaatttcaataccaagcattctggtctctttcttttggtaataatgctgttattcctttagggaactacttcccacattctgtgttattttgatgagagtgtcagtcagggtgtctcaagcagcatgagccagttaagctgggccagttgaattctgtcttctaggaagttaaatctagagcatgactagtgatgaaaaaagtcatactgcttgatgtcctgatgtccagtaaactccttggcctttattttcaggattaaatgggagtagacattttaggccagagagatcaactatcaatcatgctaattataaaagtaagattttatatttaatccttacaaattttgcacacaggcccacattcttacttataggcattgaacaagtgacagccattgcatggcagttaggaggaagtctggaattcaaatctaggaatttttaatgtcttctcttgacaagatttttatggaaaaagtgtgaagatttataacacttactctggaaaggatgacaaccaagacaaccaactgtaggcttttaatctatggccccaaatcagggatatttaaatttctactacatatgatgatatccaaaatattttcatgatgcactgaaaatttatcaaataggaaaactgtgatttgggtgatagtttatatatttgttgtagtgcaaatggaatactaattttaatggcccctatatacagagatagtgaaaccgtaagcaacagcatttgaaaataaatgcactgtgaacaggttttataaatctatgaggctaataatatatgggatctcgcctataggagagacttggtgttgtttgttgactatctttctttagcaaacgtttaggtaacacttactgtgttaaatatatatatcaatgctataatttcccccattaacagatgaggaaactgaagtcatggagagatgaaatagcttgtcaaatatcccacagctgtgttgaattcatctcattaacaaatcagttttattaatcaccttagaggttgcctctggaatgaaatgatgaacaacgtgcatgaagcaattattttcattaccatatctgatgaaaataattgtttaattgtttctacttgttgaacaattatttattgagtacatagtacatgcaccactgcacaatgtacagaaactatatagtgtacaaaataggcaaatgtttgacttcataaagtttatgttctcgtgagaattctgtaaggatattaatacttgaaagtgatcttgttttaagcttttttagggctggcactatgtcttttgtctctgtattcctgacttccaggtcagttcatgatagatattagagagtacatgaataaaggagagaaaaagtaatgaaatgcaacatacaatgttcctttatttttgttttttatttgaaactctttcctgaagagtaacatacacttatatagagaacatttggtactgtagaaattatgcaaaatataattatcactacattttcaagttgtaaataaaaataaatatattatttgggaataggaaatagttatgttattgaaaagggaagaaaatgtggcacaacatttcaaagcttttatctataaagtgctttatatgatgggcagtggctaattaagattttcagattaatgggtaaataaaacctatcttagtctcttctttttagctgaattgggatcacaattatagagcactaaaagagaaaaatctaagtttctcaaacctcacatatagggccaaggacttacagaggcatatatctttcaaatagcacataaactagaaacttcagggaaaaatgcattgcagtcatttcatttattaaaataagaataacaaataatttttactttattggtttatcttcagtatatgatacttagatatgtagcccttgacctagtaggaatcaaaatagaggtggttccacttcaagaatttgtaataatcccttcactttaacacatgaatgtgttcagtattggcaaaagaacacgttgctaccaaaactgaaacaagatccttgaaacagaaaggatgttgccatggaaaaatgaagtaacactcagtgcagctgtgatgcattcatgaataggatatttttttaaaagatcatttgtgtttggtgtggctcagagggtcccaaccagatggtttccatgaacatgatctgacccccagcttgaggacttcttactggcagattacttcattttctttcccttggattgtcagatccttacattaattcagaatttactgctgcagatttatattcagtaatataaatcactcaacattttacattaaaaccacaattttatacatacagtttaacagttattttaaaagtgtaaaaagatttatgtgatagctttagtatatataatagataaaacataataattttgagtaattttaattatatgattcttatcattaaaggaactctcacaacatatattttagaaagtttattttagagttgttatgtatctgatgctactatactgttgattctgtttatgttgctcacattgtttacacttgatgaaataattgatttttaaattagtgaaattaatgtttttgattttggaaattttggcatgatttgaattttttcctaaggatatgtatgcatgtggttgtgtatggtagcatactaaactaattacctcacaatattgaaagcatttttcaaggtagtatcaatacctacatgaagtgttaaatactgacacttcatattttgaccttttaacctgaattaataaaggctatgctcttaatgtgccattttaaattgtgcaactgaaaattactaatgaattatgttaaatattttaaagcataattctaagttacctgagacaatatagacttctatttcagaataaactacatcatgatcttaaatcaataaactacttaacacacatgtactttatctaatctgcagtataagattttagaactaaaatgagctcatgcttcacaaaccaatgcgtttatttttgcaaaattttacctgtatttttcatcactgaattcatcagtttggccatgccccaaaatgtgaagcaaagacaaacaggtttgtttatttataggttgacaaattatttatcctatcaaggaattccaaacctgttaaatataatcatgttctcaccagaatagtatattaggcccaagagaagagatgttgctattatcttttaaaaatgtagtctttttgctaacatagtttctttgaatatccaagaatgtatgaattaaaaaaattattttgtatcacacctccagataacatatttttatgtgaaatattttgtaggaaatcaaccaatcatagtttgtattttctcaataacttaagtatcgtaggctgttggagcaatttgataatgagatacacagtattactttataagcaccgctaagacaaatagactttacattgcttctgaattaagaagtcacgatgaattcagttttggggttgggcttactttgtctccttatcttaacctctgaggtcctggcaacttaatgtaactctactggggataggagaacattaagataatacatgaaattacaatttaggtaatttgaagaatgaaaaaagcaagaaataatgctctgatttttaagtcttctgatttttcctattatgatgtatttatgtataataaatctgatacatgtatgtatacttgaatcattgtatataaaagtgaaagtatgtgatataaacatgttctttaatggttgtctagtgttataaattgaatgttttaaacaatgttttcttatattctagtctgtaaagtaaaaatggaaggactaaattcacgtaaaaatagccctttttaaaaaaagtaacagcaataaaatgctaggtagttctaggccttatctggtgttaacaaaattttctaataaactgcaaaagaaagagtgttttctgatcttcttttgccagcacactttctaactcaatcttgtgtcttggaaaagactgtggaagggcagatcatctcttgtcactaggcattttgtatcaagtttataacaagagtaaacaataccttttcaagtttttaaaatattcattagtgaaaataagtcataaagacataaatatggaacatttactttttttggttgtttattctggcgaagatgttaggtgtttgaaggcatatttagtctaatccgaatattttaattctgcttttcttttctagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtatatgttaacatttttttcctatggttaatgttttatatggacatttttagatttgttggtgtttttaaatgtgtcagtgtataagcaaatcagtcttctcattgaaagatttttcctgaccaaagtaagtgaactaagtgatgccatttattgccttccataccttttaatcttagtcatatattcacatatgttatctgtaaaagatcatatgcaatataatataatcattaaaatgtaaacgtaggaaaaattaacttgggaagaaaattgcttttggatattatcattaggctgaactaagaatgataagtagattgatcttaatttaagttacttgatttatgaatgaatgtattttaaatatataaataattgcgtgaatatattatttagcaagcataatgtatttttagattcctcatttgtttatacaaagtaattatatgatgattagagtcatgatcctttctccaatatatatatacttaatttctcatattgctgtgttttcagttatgaattcataaccttttgaactttggcatattcatttcaaacaaaatgtgaacctggaaagattttgagtcataaagtaatctgaatatatattataataacaaggctcaaatttttgacagtgctaaacaggtcaacaccttgttcatattattatggtgtaagtgtatgaatcctgatatcactgaaatttctacatactgtcactgaaaagcagacatagcctgtgtaatttttgatctctactttgatgttgatttctctctccttttctctatactgaaatttctattgaaatctacttttcttatattcattaaaagaaaacatgatttcactgagagacatttttggtccttaataacatgaatactattatcatacaattatagaattttaaggttaaagggaatgtttttagagtatatggtctttttgtgactggtttctttcatttaatatttttaagattgattcatgttgtagcagtctttgttgtttttatggctgaatagtattccatcttatggatatatcaaatttttttgattcattcatcagttgatggacagttgaagttgttttcactttttggcttttatgagaaatcctggtataaacattcctttacaggatttttgtgtggatttgttttaatttcttttagctatatgctgaggagtaaaattgttgtgtcgtatagtaactatgtttgagcttctcaggaattgccagactgtcatccaaactgtctgcaccattttataataccacattatgtacaaaggttctaattttttcacatctgtgtcactatttgttattatccgctttgtttctttttcttttctttttttttttattttgttctagccatcctagacaataacctcttaaactggagagagcaattaattttaagtggtttgtttcttttttttcttttttttcttttttttgagatggagtcttgctctgtcgcctgggctggagtacagtggcacaatcccggctcactgcagcctccgcctcccaggttcaaacaattctcctgcctcagcctcccgagcagctgggactacaggcacttgccaccacacccaggtaatttttgtatttttagtagagtcagggtttcaccatattggccaggctggtttcaaactcctgacctcgtgatccacccgccttggtctcccaaagtgttgggattacaggcgtgagccactgcgcctggccaaattaaagtgtttttaagaactgtgttggtcaggcagagagtaaatagattgatttaatacatcatttaatatactaaatacacatcttaatatttataaaactgaagcttacattatgaaactggtgtttatttttactataaaaatagtaaaagtggtgtgaagtggaatctcattgtggttttggtttgcatttccctaatgactaataatgttgaacttattttcgtgctggttggccatttgtatatcttctttaatattttatttctttttatttatttatttttttggatcaggtttcattcttgctgaggctgaagtgcagtggtgcaatcacggctcactgccgccttgaccgccggagctcaattgatcctcccacctcctgagtagctgggactacaggcacacactaccatgcctgtctaattttttaatttttgtagaggtggggtttcaccatgtttcacaggttggtatcgaactcctgggctgcctcagcttccaaaagcactgggattataggtattagtcaccctgcccaacctaatattttcttctattcaaatcttttgcctactttttagttgtatttttagtagagtcagggtttcaccatattggccaggctggtctcgaactcctgaccttgtgacttcttacagttgagttgtaagagttctttattatattctagatacgatacccttacacatgatttgcaagtattttctcctgttctatacattgtcttttcacttccttgatggctttctttgtcatataaacatttgtaatatgaaatttttataatatgaatatttatattataaatttatataatataaattgatattataaattttgtagtataaacatttggcaagacttcatctctacaaaaaatttaaaaattacccggttgtggtggcttgagcctatagtcctagctccatgggaggttgaggtgggaggattgctggagtccaggagttccaggatgcagcaagctatgatcgcaccactgcactccagcctaggcaacagagcaagaccctgactctgtaaattaattaactaagtatatataatacatgatatataatatgtaatatatactttttttaataattataaattgtataaatatatgtaaatataaacataatctaaaaagttttcctgtgctatgttggaaattattttctcactattcttttttttaatattagaaattaacaccatttccacaaagtatgttttagttttagaaatattaagatgcatatttaatttatttaatgatgtagtaaatcagtctatttactctccatctgaacaatacagttcttaaaacactttaatccttctctccagattgaggttattgtcataaattttcttttatttttaaaacttgatatcattattttgtaatataattgcttagatttggcatatatagaataaggcagaggttggaaaactttctcaacaaagtgccagatagtaaatattttgtttcattagctatatggtttctgttttcactacccaaccatgctttatagtgcagagacagccatagacaatatgtcaatacattggtatgactgtgttccaataaaactttatttacagaatctggtggttggctgcatttggccatgagccacatttgcctacctatatgctagtgctttagtagtcattccttttcacagcttagcccttccttctttctcagttcatttacttctgcctaaagtacatcctttagaagctgtttttgtgatggcctgatgttagcaaactctcaattttgtttctttgcctttttttttgaaatatattttctgggtatataaatccttgtttatagttattttctcccagctcattaaagatactgttgtgctgactcttgcttttcattggccttttaggaggtacaatgtcatttcatgtttccttggaagtcgtttgtccttttcctctgggttctttaaggatcttctcagtctttgtgttttaaagttttaatattcgaatcttatgagtcctgcaagttttctggcataatctattcagatattgcctttactttttttctttccatacatatgttggacttttttgattttttactgtattttccatgttgtttcttcactctttgatattttttctctttgatttgctgacctgcattccagttaatttctttaatctagttcattaattttcttttcaattgtgtctaatattttgttaaagttgttctttgaatttttcaatgtcaactgtatgaaagtctaacatacagaaaatggtacaacgctaagtatacaactggatacatttttgtcagataaatccatacatgttactagtacctgaatagagatcaagaatattcccagtactcagaagatcttctcttggaggcaaattgtgtttaacatctaaaaccgcaaattagttttcctgtttttgaacttcatagcacttattgaatagcacttttattgaatttaaaattttacataggatattctttttatcttgattctatttaaaactctttattaatattttcaaggcttccttttatctctttctgcatgaaacttttaacttacgtgattgcctaattcctgctgactcttgcctactatacctaatattccttgtttatacttttcttttctgtgctacttattttccttagaaatttctctgtagaaatgttttgaagcctggcctgaaagattcctcctatacaggcttgaatttacttccaacatgttggtggcactatgagttcagaaccatttgaaactaaattcttgataaaaggtttttatgccacttagataataaaaatttaagctacagccttgtggttgtgggttttccccccacccatctattgaaggtttcattttctggcagcgtttgtgagaggatcatataaagaagggaagagcagaaaactttatttctagtttacctgtacatgaatattctagccatttgcatgccagctttatcttttattattttctgcactgtgagttagcttcaggctttatcttcagtcagacttaacttgacttcagttcagtggtaaacacggatgctcaattttaaccaactttgaagtgcctcgggcatttactttgcatacctctgtgtttctggtttccctcagcccctggctttaattatctttactctttttggaaattcattaataagtttaagaagatatcatttggtgtgtgtgtgcatgcatgtgtatatgtgtaaaacattatataaattttatagtatgtgtcacatattgttaaaatacagtatagtcatttttatttttttaggagagggatcattcaacatatttatcgtgttgctgtaaatagaattcctcagttatgttttttaaagatgatgtgacactattatactctgtcttttcaaatgattttataaaaggaccgatatatagtgcccatcattctttataccttcaatactcatttaaaatctctcttatttctacaaaactcctgccaacatctactgcttgtctttttcatattaaaaaattattttattttcatcttgtttttcaagtacatcaagaatgacttaggaactgcggaagtctccatctttaaagcataaggtgctattatattctcaggtggttttatttttatttatttatttatttatttatttatttatttatttattgcaagaactgagatggcaacttaatttattttgaacttaaaaaaaatcacataccagatggagagggcttgaatcaaattgaaatttccagtctatttttcatactccctaagagaatatagagtgactgcataatcaacattgaaacatgaagtagaaacaactttttaaccacatggttattctcattgaccaaacctactctgaggaaaagagattatttcaagatatttaaattctcttttggtcttaaaaaactatagaaattaacttcttatgaataaccagaaatctatccctttttctgcatttaaaatggtgtttataaaaatattataagcctttgatgcatacgtgttaaaagtaatttactctttgtctttacacatgtacccagatagaaaactgatttggaggtttacttactcatttccagttttcacacagcccttctggtttcagtgtcatgcctgtattctctttttcaatctttcttgagtattgggactgatggcatgaattagactgctcttttatagcttccttctctggtcctcagtcatttgctatttacacacattccagctttaaaaaatttgtgatatatttcatcttcagtcatttcctctcttgttcttattagtcctttttgatttataatgctttttccatttcattgtcattttgttggtttcaaaatgtagataactttcaatcatttatgttcaagcagatacaggatgtctgaatccattccacctcctattatacccctttccattctacttctctgatactattgttttatgtttagctcatttttgttcagtaaatgtttcttagtaagtatagaggatggattgggggtaattggataaagtaggaaacctggagtcaagattagttaaatattccagatagccattatagcttagaagaaatgattgtcagaaccagggcagtggtaatagatactgggacagaatagagagaaatatttaaaaggttgacaaaaactgtccaaacttaatgactggattagttatggatagggaaggagagaaaaaaatctgtagaataactccgtggttcttagcttagatgtcaatatacattatttacatagttaatattatggttaggaacaaagaaagagggccagtttttggtgtgcatggtgggatggatgaatttagtttggtccatatggtgaagtatccatgggacatttaagtaaataaatctgatgagctgctgcatatatggatctagagctctaaagagggatcatagagacacaaaatgaccacagggaaaacatgaaaaaagataggattatccgaagtcatttatagagtgacaaatgaagtgggatctgcatataacaaggcagggaacgtaatgttatgggatgagaaaggaaggaataatttgtgatggaagctaccaatagaaggtcaggtaagtaaggaaaactgtgaggaaaaactgtgaggcactagtcttatggcttaagacgtaagattggatcatgtataaatgattagatcatttataaatgtagccaataagataaggactaaaaactataaggtttcacaattttaggtaactggtttcttttatcacagtattttcagaagaatgatttttttttttctttgagatggagtctcacactgtcaccaggctggagtgaagtggcacgctcactaactgcaacttctgcctcttgggttcaagcaattctcctgcctcagcctcttgaatagctgagactgtaggttcgtgccaccatgcccagctaatttttgtatttttagtagagacggggtttcatcatgttggccaggatgatcttgatttcttgacctcgtgatccacccctcttggcctcccaaagtgctgggattacaggcataagccaacgtgcccagcaagaatgattttaatgacagtcagtgatggtggcttgagaactgaaaaggaaatgaagaactaatttaataaataatttgtttaaaaatattatttgagaaatgacaggagaaaaaggatggttcctgaatgtatatataccttgatattgtttgggtgcaggaaacagaaaccaagtcaggataactaaagcaaaaatgaaacttaatgattcattgtctatattctattatagaaaacaactttgacttttagttaaaattttaatattactcccaccatctgactctggtggttatgaagaccatatgttcaattaaaaatttcttttctgccacgtgtggtggctcattcctgtaatcccagcatttgggaggccaaggtgggcagatcacaaggttaggagatcaagaccatcctagccaacgtggtgaaaccctgtctctactaaaatacaaaaaattagccgggcatggtggcgtgcgcctgtagtcccagctactcaggaggctgatgcaggagaatcgcttgaacctgggaggcagaggttgcagtgagccaagattgtgccaccacactccagcctggtgacagagcaagactctgtcttaaaaagaaaaaaaaatttttttctttatcttttttttacttgtcctcataacccctgagaaattatttttctctatctttagaattgcttgtttatcattctgggattccaaatttctattaaatttgcaattctttgaaaccaattatttagattcatgatggaatagaccaaaaagaacacattcgtatgtaactaagattatatactcaaaccttttattttttatggaaatattttggtatattgcatctgttaatatctgactttataagcagaaaatatggtacaaaatttaataatttaaaaaattactcaggattatcattgtgaatgcaaccagaataataaatgagacctctttatttataccttcaaatttttttagtatactgaggaatgtaaaaatgacataaatttgattccagtacaccttgaaacataatctacaactttacaggtaagggagttagttggcacagcattctaagggtgtctgtttttttcttttaattcctaaaacctaggctgatacttccttcaaccatctgtcctctctatcccactcaatcctccagcctttttttgtatttctttattttcctaaatttcccttatttgtcccattcattcaacaaatacatattgagcacctaccatgtggcagtcacatagagaatacagatttgaacaagacagatatggtgcttgcttgttgatatcttacaagctattgggaagagtagtgcaataaatagtccttggttgaatcttatgtattgctggctattgatatcttttcctagggtaactaaagattaaatgagatatacattactttgaacagtgtctggtaagtgctcggtaaaaaccattatggttctcaacatccatgtaggatttccaaattccatggcctggttttcaatctttgctgtttcccagatacattttctttccttggtctcttctgctgccatgttcctggaaccctgtatggaactctatctccgtaataggcttataactcttcacttcctttaattcacttatagaatccactcacaaagaagtattaaagaatgaagtagagtttgctgaagatgtcctaccatagggaagaggtggtactggtgtaccctgtatcaaacggtgtttaaagtggctgttagtctcttagacatgtttgtacaacacagtgcttatttggcccttttctcttcctctttaatctcttgaccaaagtaatttgaaattcctctccttttgtcatgcagagtaatttagttatttttgcgtgcaatccttttgatggcttcctttcagtcttagggtacatttaaaagtccttaacatgaccaagaccccatacgaattggccctgcccacctctccagttgtattttctgctacactccctgctgcttgctttgcccacctccagccctagtaacctttctgtgttcttggaataagcacagcgctgtcctatcacagtgccttagcatatgctacaaacatgacttcatccttcccaatctgtcctctaggcatctttctccttctcctccttcaggcttcagggcatttcatttatcaggtccctccaactctgtgctgtctttgtactccagtcatcacttttacaaactttatcctaattttaactatttttcttcagtatctgattcccctactagggtgaaaagagcaggagccatacctctcttgctcgttgctgtattaccattatttagcacaacacatgccacaaaaggggagctcactgtacattctcaggccacatgaaattttcaagttattcatggtaaatcgtggttggttactctaagggaggaagaacttaagaaattaaaaagttaccttctaacttatcttaagatccataaacaattgaaaaataattcctggtctttacgaaatgaaaaaaaggggggaaaaagcattacatagatgattaataggatgaacaaaaagttctctgtagatttgaggctctgtctatgctgaacttggacttctaaagttcaaaatgaggaactgtttgctgaaatgtgtcatctgatttcaattgctgtggaaagggagagatgatctctaatatagccagctccaatctgtgtagggtgtttgggtcaaaatcaacatcttgagtttcattagggagcacttgcagtgagccttgcagatgtaatttgctacatccagccaacacctctgagcagatggatttctacactgtgcctaagagaggtttgttttttcttctttgaatgagttgcctgtgacttttataaaatattttgacagaaatggaatattgagatcatttataaattaaaactttgctgttgttggatttagtgagttttaatagaaactgatgtgaaaattatttagcatctatgaaaaacacaggggctgcttttctatgtaattcttgttcaccttagtggtttatatgtattgttctattttaggttttttaagtcatagttttataatcataatttccacttgttctgaaagatggtgatgtactgttacaattattttctttccagtttcacttagtgtgtttgactttaatcctcaaaccgtgtatgcaaataggattccttggggagaaaaggaagctcagaaactaacttccaatttgtttttgatgatgttgtttttaaataaatttgttgggaacaatcgtgtatgtattactagtaaaattaagctgttgcactacctaaatgtacttaatataattgctgtagacattattcttctctaagtagctcacattcagccttctttatcatttatttagttaagggttctatagcttttaaaggctgaaaaggaaacttaccctatttattccttgcttatcaattttgcatttcccaatctcctccctctccccaccacacttattttaaaaaccaaaccaatatggcagccctaatatgctgtcatatttttcctgatcacatttttagactatttttttaaagcagtttgagtttcatagcaaaattgagaggaggagacagaaatagttcatatatcccctgctcctaaacctgcgcagcctctccaattcagtacatttgttataactgatgaacctacagggatacgtaattgtcacccaaaatctgcagtttactagaggactcactctgggtgttttgcattctgtggacttggagaaatatataatgacatgtatctgtcatcgtagtatcatgcataatatttttactgcccccaaaaccttctgtgctcaacatactcatttctcagcccttgcaaacactgatattttccctgtctccatagctttgcctttttaagaatgtcatataattggcatcaaacagtatataactttttcatatgggattctttgacatagtaatatgcatttttgcttcttccatgtctttccatggcttgatagcttttatttttttgagacagggtctcattctgtcacccaggctagagtgtagtggcacaatcatagctcactgcagcctcaaactcctgttctcaagtaatcctcctgaggaggactatttgccacctcacctggctaaatttttttgtttttaaatttttgtagagacagggtcttgctgtgttgcaaagggtggtctctaactcctggtcttaggtgatcctcccaccttggcctcctaaaacactgggattacaggtgtgagcagctgcacctggctgatagctcatttctgttgtgctaatatttaattgtctggatgtactagagtttatccattcatgtgtaaataggcatcttggttgcttccaagtgttggcaattttaaataaagccgctatatacctccatctgcaggtttttgtgtgaacctatgtttttggcttctttcgataaatactaaggtacatgcatgactgccagatcgtatggtaaaaatgtttagttcggtaatataccaccagactgtcttcaaagtggccatacaattttgcattcccaccaacaatgagtgggaatccctgttgttccacatactcactagcatttggtgttctgaattttggccattctgataggtatgtagtggtatctaaatgctgtttaaatttagtttcctgatgacatgttctgtgaagcatctttttatacgcttatttgccatctgtatgtctttgattgaggggtctgttaaggtctttggcccatttttaaaaataggctttttaaattgttgagttttctttgtatattttggataacagtcccctatcagatgttttgtcagatattttctcccagttttgcttttctttttgttctcttgagtgtttttgtttgcagaaatttttaattttagtaaagtccagcttatcagttctttctttaatggatcaagcatttggtgttaggtgtaaaaagtcatcaaaaagtcagggttatctagatttcctcctgttatcttttaggagttttatagttttgtgttttgcattaggtcttgtattagtttgttcttgcattgctataaagaaatacctgagactgggtaatttataaagaaaagaggtttaatttgctcacagttctgcaggctgtacaggaagcgtggtggcatctgcttggcttctggggaggcctcaggaaacttacaattatggcagaagacaaagggagagccagcacttcacatggctggagcaagaggaagagagggagggttggggaggtttcacacacttaaacagccagctcttactgaagtataatttatataatgtaacattaaatttattaagatgtataaccatcatcataataaagttttagaacatttccattatcccaaaagttttcttgtgtccatttgtagttgatccctgctcctacctacagccctaggcaaccctgatctgctttctgtccctataaatttgccttttctggacattttaatacactggaatcatacaatatatagtcttttgcatctggcttctttcacttggtgtaacattttggtgttcttccatgatgtagcatatatcagtagtgttcctttttattgctgaggagcattccattgtatgattatgctacattttatcaattcaccagttgatatgtacttctactttttgcctacagtgaataatgctgttatgtacatttaggtacatgtatttgtatggacagatgttgtaactgatcattgatagagtctttagagtggaatttttgggttgaatggtaaatttatgttgaacagttcaagaaactcccaaatcactttctaagtggttataccgttttacattcttgtgatcgatttgttagggttagcgtagctgtgggtttttcagagatgcccatcatcattttgagaatgatccattttattcctagtttactgagaccttgaatttatttatttttttgaggcagagtctcactctgtctcccagactggagtgtagtggcacaatctcggctcactgcaacctctgcctcctgggttcaagtgattctcgtgcctcagcctcctgagtagctgggattacaggcgtgcaccactatgcccagctaatttttgtatttttattagagacagcgtttcaccatcttggccaggtttgttttgaactcctgacctcaagtgatctgcccaccttggcctcctcaagtgctgggattacaggtgtgagccaccgcaccagccattttattgaaaccttttaaaaaatcatgaattgcttgttgattttatgaaatagttttttgaatatattgacatcatgtggtttctatactttatgctgttactattgtgtattaaacaattctatataattcttatgtataattaataatcatgtgaacctagtatttctcaaatgtatcccatttggtcatagggtgttatcctctttatatggtgctggatatgatttgctaaatttttaaaggatttctgtatccatgcttattgaggggttttagtctgtagatttcttgtagtgactttgtctgcttttcatatcaagttaatgctagcctcaaagaatgagttgggaagtctttcattctgtcctgtttttgtaagtgtgtattagggattgacattctttccttaaatgtttgatacagtttaccagtgaagccatgtggaattggtagaacttttttgatggaaagtttttaaattaataatttaatttctttgttataggtctatacagattttcttccttctttagtcagttatggtaagttgtatctttcttttttttttttttcttttgagacagaatctcactctgtcgcccaggctggagtgcagtggtgtgatttcagctcactgcaatctctgcctcccgggttcaagccattctcccgcctcagcctcctgagtagccacgatcacaggcgcccaccaacatgcccggctaacatttttatttttagtagagttggggtttcaccttattgaccaggctggtcttgaactcctgactacagatggtccgcccgctttggcctccctaagtgctgggattacaggcatgagccactgcgcccagccagtaatttgtatctttctagacagttatgtattcatcttgagttatctaatttgttggcataaagctgttcttaacattcccttttaatctcttttatttttggtgagttaatagtgatattctctcattcctcattctggtaattgtgacttatcccttttttctgggttaagctaaaggattgtcagtttgataatctgttagaaataatttttaatttcgttgatttttttctatcttttttttcatttcattgatttcagctccaatctttactattttctttttttaatagctttgtgtttagttttatcttattatttctcatcttaacgctaaaacttagattattgatttgagaaatttattcctgtatgatgtgggcatttaatgctataaatgtctttttaaccactactgaagctgcatcccagaaattgtgatatgtttacattttttattttctttaaagtgttctgttattttccttatgatttcttctttgggccctgggttatttagaaatatgttgtttaacttccaaatattttacaatttcatagatttctttttgttgctgatttcttttttttatatatatactttaagttttagggtacatgtgcacaacgtgcaggtttgttacatatgtatacatgtgccatgttggtgtgctgcacccattaactggtcatttaacattagttatatctcccaatgctatcccccccccctccccccaaccccacaacaggccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctgcaaaggacatgaactcatcattttttatggctgcatagtattccatggtgtatatgtgccacattttcttaatccagtctatcgttgttggacatttcgtttggttccaagtctttgctattgcgaatagtgccgctataaacatacgtgtggcctgtgtctttatagcagcatgatttataatcctttgggtatatacccagtaatgggatggctgggtcaaatggtatttctagttcttgatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcacttctctgatggccagtgatgatgagcatgttttcatgtgtcttttggctgcataaatgtcttcttttgagaagtgtctgttcatatccttcgcccactttttgatggggttgtttgtttttttattgtaaatttgtttgagttcattgtagattctggatattagccctttgtcagatgagtagattgcaaaaattttctcccatgttgtaggttgcctgttcactctgatggtagtttcttttgcagtgcagaagctctttagtttaattagatcccatttgtcaattttggcttttgttgccattgcttttggtgttttagtcatgaagtccttgcccatgcccatgtcctgaatggtattgcctaggttttcttctagggtttttatggttttaggtctaacatttaagtccattgtggtcagataatatactttgtatgatggtcattcttttaaatttattaagactttttttaacgtctagcatatggtctgtttgggagattgttgcgtaggcacttgaacgtgtattctgcaattcttggctgcagcattctattaatatatatgccagttacgttgagttggttgataatcctgttcatttcttctatcaccttattgagtttctgtctaattattctatcaattatggagagcagggtattgaaatcttcaagtgttattttttagttgtctattttagcatttaaattctgtcagtttttggttcatgtacagtcatgagtcacttaacaatatgttctgagaaatgcatcattatgcaatttccttgttgtgcaaacatcatagaatatacatatacaaagctagataacatagcctactctacatttaggctatagcccatctgtggtataacatattgctcttaggctacaaacctgtacagaatggaactgtactgaatactgtaggcaattgtaagttttggtaagtattaattgttaataatggtaagtattttttattttatctcaaacatatctaaacatagaaaaggcacaatagaagtatggtattagaatcatatgggaccaccattgtgtatgcagtctgtcattaagtgaaacattgttatgtagctcatgatgtattttgagattctgttgttagatgtatatgtacctatagttgttaggttttactaaaaagttgaccctgtttattattatgcaatatctgtctctgtaatatttcttgtcttaaatcagtttttatctgttattaattatagctacttcagctttcttatggttgtggtttaatagtatacctttttccagctttttacgttaaacttacttttggttttgaatgaaagtgtttctagtttaaacagtattttgttaatcttgctatttaatgcagtctgacaatctctgatttttaaatggggcttttaacatttccatttagtgtaataataatatatttgaactcacttggtaatttgctatttgttgtctgttgttcctgtcttttttgttactctgttccccttttactactttatgtgctttatatctgtattttagtgtaccatttaattttctctattcatttttgtactatgtatattttcaatggtggctctcggagctgtattatgatttgaatttacattctacctcagttaagctcctaaattaattctggtaaattatggaaaatttgttctaatttatatctaatctttatcccccttattgacacatatatctacatataatataacccaatgttacagttacagtgttataattattgttgtatatattcagtagcattttcaagtacttaagagaagaaatgatgaatactatatctgtagagtctttcatataacccacatatttgtcatacccagtgctcttcatttctttctgtacattggagttaacacctgaaagattgcaggacaaggtatttctggtaaggaaggtctgccaccattgaataatctgagtgcctgtttacgagagaacatctttgtttcacttttagttttgaaggatagttttgctgggtataaaattattggttgactgttttgttttttttttcttccttggtagtgttatcagtttccactgatagtgttgctgagtgtggacattgttcaccactccaaatcaagtgacctctctttgatcatggcagcaatgccaccagtcctcatagttgtgctagtggaacctcctctgtggtagagatagaaatgacttcatgcaagaacatcacagattctcactcttcgtatcctaagttcaacagttcttcaagcataaatgcttttctcattctttcaatcccagagtgctgaaatggttgtgttttttgttaaatgttgtatcaactgtatctagctttgcagtttatttttggaaagaggattttaaaaaacctccttatttggccataactgcaagtctaacccaaatcctcttcttttctcaagctacttcatgtattactagtttttttttttaaatatttagcctggaaatgattgcatttcactatctccttagattggccccattacgagtaaggaaatgcaatgcattatgacctatgcagaaagaattactggtgactgctttatacttaagacaactgtgagtgtggtagacagtttgtgcaataaatagcacaaatgtatgattacatactctctcagattttcattttcatgaaatgaagttcagctttgaatcattccagctctttgacatctgagcttttcttcttacattcctgacaatatttaggaaaattacttgtgactttcattaatgatcttgcaagcttttctaacttatttaatgtctttgcattccttatagtagctagataaatttttttttaccgatttctttaaggttatctaattgttttccctacttaacaggcaacattcatattactttaatggaagtcagtgaaagcattgacaatttctcatccagacccatcacattcctaataaagagcctttgcaattctcctagaatgtttctcttccaaatagtcccacagctcactctctgaagaattacactttttcagaaaggccttactggagtatcctattttaaaatgacaccaccatcagctagtgtcccattactctgctaattgttctccagagcttttatcaacattgacataaactaaatatcagttaatagttggttatctttctttctaccactagaatgcaagctctatgaaaacaatgagtacgtattgctcagtgctctgtccctagatcctagaatgaggtcacataattttagctcagaatattggttcaacaaaagaatctgccttactagaagcaatctttatactgctgccaatgcttaagacccagccgtttttactcattcattcccctccctcccttccttccttcctttcttccttccttccttccaacttccttccttcctttcctaactctcccttcctccctccctttctccctccctccctccctccatctcttccttttgtgtactgtatgctatgcactgtgtttttagagaacttgcttataaactctttattttctccatggtggcatgtaagaatatcaagatatcttttcatcttgtccaatcaagataacaaactttttggttgtcaaatcgattagaactttttttttattcttgacatcattggttgattccttcttaaatacctttctaacttctggataaccactctcttttggttttctgtggatcttggccattctttctgaacgttcttcatgggctgtttttccctttcctctacctttctcttaaatacaggtattcttcctatgtacagctttcctaaactttagctatcatctttcactgatagtttacagatctctaagattttcacatacctgacttctttgttcctttcttatatgcccagatacccattttagctatacctatattaatgttaaggattgaatatttgtgttccctcaaattcatatgttgagcccttaacatccaatgtgatgtttatgaggtggggcatttaggaggtaattaggtttctgtgacatcatgaggttggagccagtgggattagtaccttaagatgaagaggaagaaataccagagcttcctctctcttggtcgtgtgagaacatggcaagaaggttatctaattgttttccagcctcaaagagtgttcttaccaggaaccagatctgccagcaccttgatactagaactcccagagctcttagagatggatgtctattgtttaagccactagtctatggtattgtgttataacagcctatgctgaccaagacagctatccattccatggcactgatgttaccgataggatcttgtcttatagagagtagtaggagtcttcaataccaatttaccctaagtcacacactgttataatattcacatttttagcaaaactatagggtaactactaatacctttgttgttggaagggcaatgctattcttttcagtcccttcttcttttaaaagcagtgattattctagttttgcattgtttacaattgaaataatgttttagagaatcttagagtattatatttctttatgaataatgaaatgttgacaaacaagtcacgattaatccagtagtgactttcagaagtaaataatagttttattagtaacatagatttctatatgtaaaatgtttttcacaaatttgaaatcaattatctcttaatactattatcattattattacattttgtacatgcagttcatttcacatttcctaacacaaaacagtattccaaatgtagaattttagttacagagcaaataaaactgaaggttgctcattttcatttcctttctttctatgcctttcaactgtcttcctcttctatgaagatggactagatatcatttataatgtcttgattttctttaaagtacctattacttaaattaacatcacttagaattaataaacactttatctttaactgtctattttattttattttaagatggagtttcgctcttgttgcccaggctggagtgcagtggcatgatctcggttcactggagcctccgcctcccgagtttaagcaattctcctgcctcagcctcccaagtagctgggattacaggcgtgcaccaccatgtctggctaatttttttgtatttttagtagagacagggtttctccatgttggtcaggctggtcttgaactctcgacctcaggtgatctgcccacttcggcctcccaaagtgttggtattacaagcatgagccaccgctccaggccttaactgtctttaaataagttaaatgctaactagtttggagtaataaacactctcagcaattttggcctatttatgtttgtagtacatctttctctcgagtgttatactcacaataggtggtagaatgttcctggttatactggttcatatttgaaatacagacctgcctgagtcatactggttttttgaatgtaagagaaaaaactgggagaagaggaaggcatttttgttgttgtttcttttgacaaacattcagtgactaaggtaatgaaaacaaagaaaactgaggaaagtatctccaatattgaccagcattctttccacatttgctaaatagatatttgtaaggtgattcaaactggcctcaagtacatacactttttcctgtagtgtagtagagtgttttttgaaaggaaaagactgattatctttccagaatattgattcctacccaaaaagattcagggtcataaattatatttctgtgataaggatttgtataaatagtcattgttcactaaccgcaacattgacaaaaacgttttttatatctatattattaaaattatttttgtgtcatgtaaaccataatcttttgattatagcatggtatgatatcagcaacatgtgatacaatataaagaaatcccctgtaattttctttttaagtttcactcatttgtaagtttaatatgttcctttggggacctcctccctgctccaccccttggcgttgacacatgtaacgcatagtctcactggttgttctttatttattcattttgtcccaaagctttctgtcatattcactttctttcacattatttggtctgaattacatcagtgtttggtcatcattttcttgagaattgttttgtttgtattcttttctctaatgataatatagaggggtaacaaattcacatacaaagagattctcaatcttcctgccttgttctttttttcttattctttagacattttgcttgaaaattttttaattctgccggcaatattttctctaaaatgaaagacttagattatagcattacaactttccaagtaaaataaaaatcttaatcttgaaggtcagcccagattgatagaaagctatatgaagttctcagaatagtatgtggttctggccagtcatggatgtctgaacatattttatggagtgcccagaacattattttgccagtattataagtagataaggtgttttcattctggtgtgtgtgtgtgaaaggaatacttgtgcagttaatgtgttttgtgaatttttctcacagtgggaaattgtggaatttttgtcattgcatgttaaaatttcatcttctaggtatagtgtgctttttaaaacaatctgtatgctaaataaatggacatgaagtgtagtaccttgaaaggttttttttttttttttaggagttagggtatgatatgctcaatttcaatttcctaatctgattccaaagaagacgcagaaatataactgtgatagtaccaatgttatttgggatttttaaaaatttaacaaattttaatctggtccccttccatccagcataaccaccatttagcatttcttggatacaataggatttgaaaaaatatatatagctcactaccagctttaaaatatataatccgaactcagtccaaaatattttaagacaaatttggcagagcctttattttttaaatagcatggaatttgatgtaggttttaaaataattttagaattagttacagatgatttagtttgtcattcttcctagggggaaaaatattttaaatcttaagacagacaaagtaccatagtgctgaccacatattattatgcagttatcattgtttccagtcaagttattgtgaactatgttgctaggtttattttattatgcaagtctcactttcaaagtttctaattttataataattttattaactatatttggtcaagacatttttaatgttcaaacttataagaatgtatcttctggtacctactgaatattgaatatatatttagactcctctaaaatatttgtagtatgatctacctagtaattcacttggtattttttcttcagtgaaaaaacaagggaagaccatgagtgcagtgtgatctctgatctcatctctgcctgggcacatccatcacccataggggaaaaaatatatatgaaggaaatataactaagtgttaatattatttattattgggggtggcaaaatagaaggtaaattatgaatggttttgatattttcttctttatatgtttcccaatttatctgcagtatggcatctattacctctctaattagaaaataaatgtcctcaatttgttctaaaataattgaattactaaaaatgatgttcgtgttatactctctgtactgacaagcactagtagaattgtaaagtccaaaatacaaatgatataaaattgatatcaccataataaatgtttaaaaatattctaatactaaatggactttttaagagttcaaaaattactttcctatatttacaagaaataaatggctttatctcaaatgtttatattaataaattaattttacctgagataagtcagtaaaagctcaaagtataaaaagggaattttgcttttaatcctgaaatttatgaatgccaattttttatcaagtgcattttatttaaaaataactcaaatgtaagaataatctagggaacatatcaaaattcatgctgggtcgtaccatcagagattttgattaagaaggtctaaagtcctaggaacctgtgttttaaaccagcatcccacatgaattctgaggcaggtgatccaacagaccatattagattgtttattcttttcctgtctcattccatggcaagatctatggtcattttcagtaccatagataaaatcaggattcaagttgaatctgttcctctacattctatcaggcagagctgccataacaaagtaccataaactgggtggcttaaagcaacagaaacatattgtctcaaagttcttggaggctacagtccaaaatcaaggtatcagatcacatttatgtaatgtgatctgttttctctggcctccagggtttgcatacgtccccaacagtttcacaatacaaccaactagggtaagggaagaagaagttagaacttttatttttatttttatcccatatatttaatttctgttaatgtacggtttatagtgtatataattactgacagaattttcagtagcatgtaaattgtttagcaccgtggtctcaggaatactatattcactttttatgatgcagtattagtcataaatgttaaatgttttacattttactatcaagtgaaaattaattgtctttttgtttgtgtgcttccctattcccttttatcccctatatcaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggttggtacatttgatttatgaaaggaaatttaaagtaatgtgatttaaaagcaattgttatccattttgttgaagggtttctcttctcttgagtatcctaaattatttttaacttggccatcaagatcagggtggttagattaagaattgctttgaagctctctcaagttgtgtaatttaaactcttctgaaaatgtaatggtggcagtacaaatgtatcttttggctgatggaatgaaatcagttgcagatgtaatgtttttaaacactgaagaactattttactgtaagactggaagagtctgttgaactgatcgagtgtaattttcattcagattctcactcagaacttctttgcttatcatgcaatttttttattattatactttaacttctaggatacatgtgcacaacgtgcagatttgtcacatatgtatacatgtgccttgttggcgtgctgcacccgttaactcatcatttacattaggtatatctcctaatgctatcccccgaccccccagcccacgacaggcctgagtgtgtgatgttccccaccctgtgtccaagtgttctcattgttcaattcccacctgtgagtgagaacatgcagtgtttggttttctgtccttgcaataatttgctcagaatgatggttagtctatttgagggtaaataaacaagggttaaattgtatgcaactaattatttgtgcaaacccaggtgatgtgaattcatattaaactgtaaaattacaagatacagcatgattggtctatgacacctgaaatctttttctttttaaaaatattatttttaaaaagaaatattaaaaaaaatttaaatattattttttaaaaacattatttgttatatttgttatattaattgttataagccaatttttaagagtacttttttaagtaggttcaagttagttgagcttgatggcacatgcctatagtcccagctactcaggaggctgaggcaggaggatccttgagcccagaagttagaggctgtagtgtgctatgattgcacccgggaatagccactgcactccagcctgggcaataaagcaagactctttctcttaaaattttttgttttgttttaattcactttttatgaagcagtattaatcataaatgttaaatgttttacattttactatcacgtgacaattaactgtatttttgtttgtgtgcttccctactccatttcctcccctatatcaagtgatacttctctttggactatcagcttgcattccatattttatagagcgtcttttttgaaaccatcctcatcctttcttttcttcttgcctccttctccctactatatactatactgtttgatttaacttttatatttgaaaagattagacctaataatatattggtaagagtcttattataaaaatgcatttaattggaattatgacaaggcagctttattaaaagaacactgtcataaaaacttaagaactcatcttccactacagtaaacattatttcatgttttctttctttcctttttttttttttttttttgacacagggtcttacttggtcccccaggctgaagtgcagtggtgcaatcacagctcatgcagcctcaaactcctaggttcaagcagtcatcccatttgaaccttctgagtagctgggactatagacacatgccaccatgaccagctaatttatttcatttttatttttttgtagaacagggtctcgctttgttgtctgggatgatcttgaactcctggcttcaagcgatccttctgcttcagcctctcaaagtgccgggattacatggtgtgagcaccatgccataaggtcatttattttagaatcagtagtgaatacttttgaatgacactaaatatttcagtttaatggctatttgcctttctattatacccatagtgatatagaagaaaataattatgaaatgactatcttctttgagattactctttgagtgctgctgctaatggttgctttaaagtgtttttaaaaggaaaggaaactgttatggattgaattgtgtccccgcaaaaatatatgttgaagttctaaccttgtgtatctcagatataaccttatttggttataggtttgtaacagaagtaagttaaaatgaagtcattagggtgacccaatgtgactggtatccttataaaatagaaaaatttggacatagacacatacaaagggaagatgatgtaaagatacacatggagattgtcatgtgaacatggaagcaaagattgaactagtggagctgtaagccaaggagcacccaagatggatagttcccaccagaagaagctaggcagagagccaaggaaggattgtactcagaatctcagaggttgcatggccctactgataccttgattttggactgtagcctccaagaactttgagacaatatgtttctgttgttttaagccaccgagtttatggtactttgttatggcggctctgcctgatagaatgtagaggaacagattcagcttctttagacactttatcacagaagttgttaaaaaggaaaacataagatatctcttagcatggcagtataagctccctcagcctatctttcctactgattattcctatatactctaggaaaaattcaaaaacaaacaattgactacccccacataaatgcatgttctcaacttgttttaaaataattgaattgcaaaatgactttaaggcagcttttagaaatttttatgaggtgcaaaggaaagcatactaaatgaaaaggcaataaatctcaattgaggaataaaaagtataaaaagagtcaaatggaattttagaactaaaaaatacagtacctgaaggaagaaaaccatattatgtgggcttaaaggtagcttggagatgatagaagaaagagttactaaacttgaacatagatcagtagaaattactgaatttgaaaaagaaaggaaaaaagtttttttaaaaagtgaacagagcttcaatgattgtagaatagaaaagtcgaatattgtgtactacttggagtttcagaaggagaggataaaaggattgggatagaaaaaaaaaaaagaggaaataactacagaaaactttgcaaatttggggaaagagatagtctttacgcatccaagaagttcacctaatcccaaacaggataaacccaaagtaacaaacatttggacacattgtgattaaaatattgaaaacgaaaaataaattttttaaaattttgacaattttgacagcagatataggaaaagacacattccatataagcaaataatgatttgaattagagtagatttctcattagaaaccacaggagacagaagacattggaacaatattttggaagtgctaacataaaagaactgttaacctagtgaagataccccacagaaatgaaagagaaataaacccatttttagatgaagaaaagctaagaaagtttgtcaccagctgctctattctacaagaaatgctaaaggaaattctgcaggatgaaggaaaatgatactggatgaaaaattagatctttaggaatgaaggaaaaccaacagaagggataaatggctgggtaaatatattttttaaaaaactacttaaaaatatgtgtgactcttgaaatcaaaaagcataacattgtctgctggttttttcagtgtatgtagatgtagcatacaagacaactatagcattaaggctagtggaagatggagtaaaagaatctatggttgccaagtttctacatatcatatgaagtggtacaatataaactcttaagtagaccgaaagttttggtgcatatgttttactctcttaggacaactaataagaaaatgcaaaaatacaaaaggataaagccaaaaagtcaatagagaaattaaaattaaatactaaaaaatattcaaagaagccaaaagaagatgggaaaaagtaacaaaggaacaaaaaatggagggtaaaacagtacaaaaaataaaatgctggagctaagccagctatattaataattacatgaaatatttatggtctcaattaggaatctgcaaactaatgcccataggccaaatttgcccacactccttttttacatattgtctatggtttctgccatgctacacctgcagaattgaataacggaacagtatggcccacaaagcctagagtatttactctctggcccttcacagagaaagttcacaaattattggtgaaacactccaagtaaaaggcaaagatctacagtgggaagtaaaacaagatgctaccgtataatacctaagattgtattttacttaaatataaagaaacgttataaatagatgcatagtaaaagatacaccatacaaacagtcagcataaaaaggctggacttacttattttaatcttagatagaacaaataaaaagtgtgttaccatagatagagtgacatgaaacaaaaattaacagaattaagggaaaaagatagagaattctagaatcgtagtaggaaatttttataacacctctttcagcaatggataaaacaactggattaaaaataaataattgaagatatagaagatatgaaaatactatgcactcaccttgatctaattggcatttatagaacagtatatccaacaaccgtagaatgtgcttttttacagatatacatggtctcatttttaagaggatcaaaaatcacatgaaagtattatttgaccacagtcaaattagaaattaataataataaaatagctagaaaaactttaaatatgtggacattaaacaacatgcttctaaataatttatggaacaaagacataattatttgggaaattagaaaatattgaatgacactaaaaaaaaactggataagctaaggcaatgtttagagggaaatataactttaaagacatattagaaaggaagaaagatcttaaatcagccatttaaggttcaattttagaaagctaagaaaagaacaagagaaacccaaagtaagtaaaaagaagaagataataaagatatgagcagagatgaatggaacagttaacaaaaaagtgagcaagagatagaaaattaataaactgattcttttaaaagatcaacaaaattgacagttccttagctagactgaaataatagagagggagaaaaaaatgcaaactactaatatcatgaataaaggggagttgataacattaaaagcataataagaaaataatgaacaactttatgccaacaaatgcaacaacttagatgaaatggaaattttcattggaaaagaattccatcaaagttgacacaagaagaaaagagcaaaaccaaatagctctatatcttttaagaaaattgaatgtgatgtcaaaaactttcccatggagaaaacttccaatctagatggatgaattctatcaaatattctggaaaaaataacataaatttttcacaaatgttttcccagaaatgaagcctgaagcatccctgcccaactggttttatgaagctagcataactctaataacaaaacttcaaaaagactttacaaaagaaggaaactaggtattaatatccctcatgaaaatgatatataagttcttaaccaaatgttaacaaatcaaagataacaatatctaaaaggcataatatatatattatacgtaatggccaactaggaattatcttaaaaatgcaagtttggtttaacattcaaaaatcattcaatataatttaccataataacaaaacaaaggagaaaaatcatatgatcatctcaataaattcaagtgagacatttgacagaattcaacatgcattcatgatgaaaagtctcagcaaattacaagtaggaggtaacattctcaaactgatagagatcatataagggaaaacaatggtaaatatcatacgtaatggtaaaatattgaattgtttcccactaagatcaggaaaaagtccaggatttctgctttcaattctattctgtatcatactagagttcctaaccattacaataaaccaagaagaattaataaaagatataaagataagaaatgaagaagtaaaactgtttgcatgtaacatattttatagaaaaccccaaaggagtctaataaactattactaaaactaacaaaactcaccaagcttttatgagacaaagttaatgtattaaaaccatttgtatttttatgtactagcagcaaacaaccggaaaatggaatgaaatcaacttcactctttactaacatccaagaaacataaatgaataaatctaacaaaagatatctaagacctctatcctgaaaaccataaagcgttgctgagaaaacttaacacctgaaagaagtaaagagatatatctcctcatagtttggaagactcaaattgttgatggcttattgatcttgatattgggcgtaatcaagtttaaaaaaatactttttgaatgacacattgagatagcagaaagcccgacatttggagaaggtgtttacaagacattcttcaaacaatggactgttatccaattttttttttttttttttttgtggagacagagtctccctctgttgcccagggtggagtgcagtgatgtgatctcggctcactgcaacctcctcctcgcaggttcaagcgattctcctgccttagcttcctgagtagctgggatcacaggtgtgtgccaccacacctggctaatttttgtatttttgtagagacagggtttcacctgttgaccaggctggtctcaaactcccaatttcaagcaatccacctgcctcggcctcccaaagtgctgggattacaggcatgagccactgcacccggactaaaaattttttctactcaataacatgaagatgaacaataaatgataaacataaagacaaataatggggaaaagacttgagcagatacttcacaaaatacttatttgaatagtcaataagcatatgaaaatatgcccaatatcattatcaggggaaaaacgtcatgaagaaatagaaatacacacctattagactggctaaaataaatgatagactcaatatgtggaccaactggaactcatcatacaccgcttgtgagaatgtaaaaatgatgtaacaacattggaaaccccttgacaatttctgaaaaagttcagcacacacttatcatacaacccagcgatttctccctatgtatttcctctgagaaacaaaaatatatatccacaaaaggtcttttacacagatgtatatagcagctttatttgtatagccccaaactggacacaactcacatgtttatcatcaggtgaattagtaaaaaaattatggcctactcataccaaggtaatactaatcagccattaaagggctgaattattgataaaatgcaaaatcattgacgaatcttgaaatcattatgctgactgaaagaagccaagtggaaaaagagttcttactccataattccatttacataaaatgttaaaatatgcagattactattaatatatagtgatagaaagtaggttacttgttgcctggaagtagaacagcgagagagaataaagagggggtgataggaagaggacatattacaaagggatatgaagatatttttggaagatacagaactgttgtttttctaaagtcatagtttatacttagtggtagctcagtctctctctaaagctacatataatagacagccccctgctacttggagttatctaccaaagttcttataatttaggaaagataattgtagctgtgagaggatagtcctactccacatgttctagttatccatagctgtcctagctaacacaaaaaatattcttagactccactattattcatatttttaaaattttctttactttgagatacttaatagttttgtgatttttatggtgttactaaatgtaatactttggctcaaaactagagtacttggtatattctctagctatccacattgtttggagctaagctcagattttgttgttgtttaaatgtaaaccagctctaagcaaagtcatcagctagatggggcttgtgtttggccttgtatttccttcctatgtctgttccttccctgttgtcctttcttcagttatctggcttccagagtcacctggttcccagtgccacctttctcctgttctcctgatgccaagaacctttttttctagaattactccaaggatgaatgaaccttatgcactgagagttcatttttactcgaaatgtagtaactcttatctctttatgtaattctactttataaatctcataaaatccttggagttactcaataaatcctcataaacaaaattgtgttaaactgtcaccacctggtgtaaccaacattgatcacaaggttgttgggaagtctgaaatatttatgaaaatattttgtaaacactgaaatgttatatgaatatcattttattagtgtagactgactctgattaaaatgtgagaccatctttgcaaattggtatgaacatccctggtgaaatgtagcaacattcctgaagagatgtgaaaccacaaaataacagcactgaagaatctatataaactaaaagacttggagagggattaatactctttgatatcttcaagtgagagattaacctaaattttaatgacaaaacatgagactctaaataaacctctttgttttgagtgattgctttagcttatgcttccagactctctttggatgctttcaaaattccaaaggatggcttgattttttttttttttttccatatgcagtaagcaaattcttattgagtgctacatgtaaggcagacatgaagatgaataaaacaaacacgcaaagaacgccatatctacatacctcataatccaactattgaaagccacaagtaaagaacaaatattgaatatatcacaagaaaatacatgtatgataccttacgttcaggggaaccaagatttgattaacagcttacttctcgtaagaaaccacgaaggccagaagaacatctttaaattaggaaaataaaaaataaaacgttgcaatcaatttagaagttcttaattaagcaaaaataacttttataaatgaaaactaaagaaaaacattttcagagaaaagactctatcaccagtaggaactgcatacaggaagtactaaggaacatttttcatgctgaaaggaaatgacaccagatggctgagcatctcttcaaatgtttattggccattgagtttgctcattcgtgaattgacagtttacattaatttatatttttctaattactaataagattgagcttttttcacatgtttattttccagtgaatttgctcttttgtgatttgttaattcatatcatttagccagtcttctattaaattcatttttcttagcaatttgtaaaagctttctttaggctctataaatacaaaccccataactgtaatgcagttcatttgcttttaaactttttgacatcttctgccagaaatttaatctttcatggtcaaagatacctatatattcctttttattttctgggtatcctgtcttaaaaggagtatcatggacccctaaaatgcacgcagacatacacatgacctaaaaatgtcttttactgttttttcttttaaaattaatgtctcagaatttctttcttgtgctttctcatttatccatctgtttttgttgtttgctttttgtttttaaaatatatttgttgtaaggaagaggagcaaatcaatacttcttgtcctttttataccattggctaaaagccgtgagccaattctcagaatattatatagacccattaagattgcatactgaggtatactgtcagaaggtttgtgagcttttgactgtagccagtgtgtacgtttcttgattacattttatggaaataattcctacttaaatacctttctttgacttatccattaggatgacatcagaattgtgacccttgtacactattgaatctatttcattgttgcctagatagagtaccttcatgtagttaatgtactttaaaaatagagaaggctatgtatgtaaggtaggctgagagcaaatttattactgtatcagacattactgtctgtctatgttattcctggaactttcattgccattcagtgttcttagacactgtgtatatttatctgggttgaatatttggtgctttcgtgactagaagagatttctgttatccattcccttcatcttaactatgtgaccaaagttaccctgtttcctttaatgtctttagacaccagtatctcagaccctaaatactatgcttattccaaagttaaatgagcctgtcctgtaatcccagcgacttggtaggctaaggtgggaggatcacttgagctcaggagtttgagaccacttgagcaacataacaacatgctgtctttatttaaaaaaaaaaaagaaaaaagaagcccatagaatcttttttttttttaatgtgatgaaacttctgtttacctttggccaacaaactgatacattgttttcttataggcattcacaggaacataacactttcttagcattttggggtttatatatgtggaactgagaaagaacagatttatgccagttttctattcatttatttatcgtttttattgctgttatgttgatcagtttgctgtataagaacacaggctttgagtttagacaaaactggatttgtatccttgcaccactcacccattttttatttctctgagctcttgattttttttttttttgagacagttgtttttttgttttgttttttttttttttttttgttttttgtttttttttttttgccgaggcaggtgtgcaatggtgtggtctcggctaactgcagcctccgcctcctgggttcaagcaattctcctgcctcagcctcccaagtagctgggattacaggcacccaccaccacacccggctaattttttgtatttttagtacagacggcgtttcaccatgttggccaggctggtgttgaactcctgacctcaggtgatccgcctgccttggcctcccaaagtgctgggattacaggcatgagccaccacacctggcgcgagctcttgatttttgttttaacttttaaacgaaattaaactggacaagtgtaatcttttatgtgaaaagttgtttttgtgtaaaaaaaaaaaaaaaacaagtttctgaaactgagttttaatgattagtaacaacctacatgccaaatgaaatagtttttctaagattgtattaacttagagctctctgcattgttcaacccagatcactaaattgattggtgaaattccgtttctccttgatttctgttgacattgtatatccatgttttttcttcttcctctctacctttagtgattctattctgacactatctcctgatactctgcaaaatgggcccttcctctctagccacctagggactcttcatcagccctgtatcttgtcttgatcatcccctgcgcttggcttttgttcattctgtatttctgagtagaatgactttgtactcatctaaatcctgtctctccttcaggaatataccttgaggcttttctcagcctctccagtgaaattgaatcttttttatgaacagctatagattaaatgaaaaaagtgtgtgaataaattttttaaacataatgttacatatttatattcagtcagcattcaatacacaagacattgttgatattcagacaccttcatacagaactcatgtaaagccacctcacatggtatttattttttagggatttttaaaaaatgttttattgaggtttacttaacatacaataaactgcatgtttaaattagctaatttgttaagatttggcatacatacacacatgaaactacgcccacaatctaacatcttcaagtttctttatgttcttatgcagtcctccctcccattcctccccatcacaggtaccattgtttctgtcattatagactaatttttgtttgtttttcttagcctagcttctttcattctgcataattattttcagattaattcacattgttgcatgcatcaatagtttatttctttttatggctaaacagcatcctgtcatgtgaatgtacttcaatttgttaactacctgtcaatgtatatttgggattttctccaatttttgcctattacaaataatgctgccatgaacatttgtgtacacatctttgtatggacataggcttcatttttcttaggaaactacttaggagtggaatagctggatcatatacggtaggtatatgctctttttaaaaactgtcaaatcgtattctaaattttacattcctaccagcagaaaatgagagcgttagttactctacatccttactaatacttgatgtagttaggctttttaattttagacattctaaacatgggaagtggtagttcattgtggctttacttggcatagtgttttagcacaacttgaaggataaaagttgaacatttatcctacatgtttttgccttatttctttaaacctctgaatttggaaagtctgagttctgttagcaactttcttctttgaaaataaaaatacgtttaaagtgtgtgtcatggtttgcatggcactttaaacacacagtgtactcgttgccattcaggcacagtattttctaacacttaaaggaatcagaagtagtgacaataaaagcagcatcatttctcttaaataaatacccttagaaatacttagaacctgttttggctttttgttattgttgtttgcactctctttatttatcagttctaattatttaagaaaaagcaaaataatctttttaaaaactggtttgcaacaaaattgtttctctatagagagaaacattcataattatgaaggacaaaagaatttgaacaaatatttttctaagacctttttaataagatttttagctactagattacttttaaacaaaaatagctgtaacctgagatttgaaacttcattacacaaaaaacaggagaaaattgtacacccaagtactgttttatatcaaatgaggattgacaatagtgtttttatgcatctgttctgcccacataagaagccagcttcatcatctggatgtgtcctggggctgaaactttttataaatacgagaatttcacttttttaaaatggcaagcagaatatggtgtccagctgtggatttgcttacatattgtgcttgcattttttcttcctgggcttgttttatacagtatatggcactacgttgtcatacaaatttcatgattaatgcttatttatgaaatcttgtgtaaatatcttaggactcagtcaaacaatgtgcaaattaaacagttttttctccgaatattggaatgacatctcctttgggaatagtaggttggatatgttctttatctattaaaaaaaagtctcatatgtaacatttgccttttactgttcaatgttatatcattctttttaaatttgttttgtgggacaagaaatccagtttcaagaaatcacagagaaaattagatgtggaaattaagatggtagttatttcatattatgctaaataattacatttactagaacgcctttgttttttaattttgattctgtcctctggttgagaggcatttgtatgtgttctattgttcacatattgaaatcaatctactgtttgctaataagctgtgcttacattactgtggttttaatccacaggaatgctaggttgatgaaaatatcacagagtgagtatgaagcaaatttcaagtgtaagttaaagtgatcagtgatgcattggtagagtttgttttataaattttatttctctggaatagttaattttctcatattattattttagtggattgaaactggaagttgaaagacttgttttcttttcttttttcttatgctctcaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgaggtaagtgtttttgaaaatcctgttacaaaatgaaggttaatatataacacagatttccagatcatggtttaaaatgaagataacctcactactgtgaaaactgatagattctgaaggttcaagaggagctgtggcagcagtgactgtctattccttttagctacaagaatttctgtttttaatcacttttagcagcttatggggtagttcaggatagtgcaggttctgtgaaatggtgaaaactgagacacagtaaaggtatgtttcctcggaagtatggaaatgtagaaactgagtgaaaaagagactcatgcttcccctttccctacctctgttccgctacaccttttttgaaccaggtgactattattatctagtcacctggtttagattagtggttttcaaccctatcagacccaatgccctctcctcttcctcccaattataaaagcttttctttttatttttaacgtcctaacctagcatgccagtacctcttttgtataagaaatattttataatgcctcctttactatcctgatatgaaaataaaaatataaccagaaatgaaaatgaaaaataatgtaacttacatatacatataatttcaaaaatatataatgtcttaaataaaaggaaagtaatttaagatacagtattatgtacttcaatatataaatgcctgggcatgactacattagaagacataacggaatagtcacatgcaattactgtgaatatgatggctgcaaatagacttgtacaggtctgtatttagtaccacaagtggtattgctgttggtgacatgattttctaaactagtgacaaactcttggtaaagtttcaaacacaacacagttcaatctttcattatagtagttgaattttggaacttctagtgtatattgaaatcatgcaaaaatgaagaaaaaagtgtttagatttgaaacattttataaacaggatttttatctatgtgaatatgtatgagacagtcttcatttttcaggactgccctattctacacaggatctcttgaacccctaactcctaacctttaaatcccaataatgatacacaaacattgagtcaacaaaaaatacccccattcatttccaaaacattgcttagagaacagaactttccccaacgagagcaactgttctatagtagatggaggtagaagttaacgtttttttgtttctgcataaagacaccatttcctctgggaataaagctattggcaaaatacagaatgggataagaatcaagtaaacgggatgttaatgtctttcatcttacaaatcagtaaaagcaaacaaactcagttaaaagggcaaatttcagctgctataaagcatttaacactttagagtacatctatttaaccccctgtacaagcaacttttctatcttgcccattccaaatcttaagaatcacagtaacctaggtgataagattattctttctcttttttcttttttcttcccaaatgaggaagcgataggaagtctagaaatgagcctgtatcaagttaatgggacgtatcgtttctagagtaaaagcagtgaattctttcttgaagagttccaatattattagcatacaaaatcttttagaattcctgcagtaaaaaaagctatttaactttattgaatacagcagtttccacacttacttaaccaaaagttcatctttctcagtctgcctattaacactttacaaaatatattttgtgaaatcctttggtagagtaatcaaagtttaaggtaatcagttgctagacaaagataatacaagtgaaaatgataaatacagttaaatcttagagacattttagtggctgaaaggagagtgttccattaaacagttgttttctaagtactgtgtgtacaggaatgtctagaaaaacatgacatccattttggagtgctcactcaactcttttggaaatgtgtttttttgaaagaaacatttaaaagacatttcaagtccaggaaagacagggctcacatgaaatggtgacagcttttggtcatacatctagagactgccgttcatacaaggtatagtgtgaatcctacactctagcattgtgcagtgtacaaacaacacaaaaggacatgatggccctgatgtgaaatgtaataaaaataaaataaaataaaaacatgccctacatttatagaggaaggattaataaattcattctaagaggtctgtggctattttgtggagaaaataatatttgagatgatggatatttaaaaatgagtaagacatgaataacaattttgttttactagatgtataataatacatactagaagaatagtatcttcatcagccaaagtgaagaagttaagaaaggggaaaattttgctaaattgcttaaaaagaattaattctgattttaataatacccttatatgactgaaattcatttcaaattagaaagttgaggattttttctgattgggttataaagacaagtaatgaaaatgctcatagtagatttgtttgttttgtactatctatagatttaatctgatctgtatcagatttgaaagatctgaaaatgacaaaattttcaaaatgtaccctcttctcttatttatatagtgtggtcaagaaaagaggtgattactactagtccaatatcaatttgaaatccacttaggaagattatttgctgagaagtaccttaaaacaatttagctgatttgtttttcataaagggcaggaagatttttatgaagatggttattcactattgaagctactgaatgaaaacaatgactatgttttcttatgtcatcatttactggctaattttgaaagaggtaaatttaaacccagatgcacacatagttaatcttaatctacctgtaaatattttttgagagcaagaatagaaattaaacatgaaatattcgatagacaaacacctccttataggttgcaaggtaaagttagatcaatgccttaaaattgatcatcatatcataaccatctgggtgacagagtgagactgtgtcctgtctcaaaaaaaaaaaaaaagagataatgcttgtaaaatacttagtttagtgagtactccaaaagggaaagctaatgtaaatctccttcataaaatttttgcattaggccttgagtacacgcaaatttctatatacacagggtaccatttaaacattttcaatttagtgagtcttcattttatgttcccagctcttgtaaagtcaggaacaacactaggatttactcacaacagagcaggcaagttgacagtcagtgatatgcttcatgtaacttgttaacagatttttgaaaccctactagggttaactaattatgtcatttcaattcaacttttaattttctccttagccctaggcagaagattctgccacactaatcaaatgcttgctgtaccatagtagccctatgctgttatttgttatatcattttgttataacaagagaggaaggagctataattataaaattatttcagtgtaacaatgttatttaaattcattaacaccttattaataaggcaataaaaaatattaagaacatatttatgaaagatgaattataactcagagcttgctaacgagtgcgctgaaacaccatgagatgtgtcacagctatgctgagacatggattaccttggcctttagagtctttggatgggactagggtgaatgaagctttcaatgctgtggagatttttctgcttaccacagatacaaataacatttcctacatatgcaatgatatgaaaaaggttgggaagtactactataactatccacaacacatatattctatatttaaatctgtatacagatagttatgttgttgacatgatagtgtggctaatagaaaatattcttataatcaacagattatcaggacaatgattattactaggaggagagaaggacttctagagctttccaggaatgctatgttcaaagaagcataaaggcttttgaatagattaaaacaaacaaaaaagtatttatatagtctcctcttcatattgttcattcttttatttcttaacattttaaaataattggtttatagtccttttagatttcttaactccatttattggagatgctaagtttttgttatatctgctgactctccctttttctggttcattttctcatgtggtttgtaatatcttattgtgaactcatcttcaacagtttaatttttctgtgtgattcctatgagccctctgttgcagaattgtccctacagagcattttgactgcttttgccagggtgctagagatttcagggaaccttgggcagtttttaggtttctttatcaacaagggtttgtcttatcatataagtagtatgcacgacgtcccacacaagcaaataatagcatttagtttctcatgtttgttttggtttttttttttactatagttgtccaggctggagtgcagtggcgcgatctcggctcagtgcaacctctgccttccagtttcaagcgattctcctgcctcagcctcctgagtagctgggattacaggcgcctgccaccactcctggctgatttttgtacttttactagagatggggtttcaccatgttggccaggctggtctggaactcctgacctcaggtgttctgcctcccaaagtgctgggattacaggcgtgagccatcctgcccaggcatgaatgattttatcatgccaccactttcacctcttctctgtcctaggaatctgaaaaacatccatggcatttcttagcctgctgaagcctagtgtctagtgtatcttttgcttaaaaagcagctctgtttgcctccaggctttatgcaaagaactccccagttcagactctacactatgtctgcagtccctgaatgagtgtttaaacaccattgctcaacccctcgacccttatctgagtttgatacttctacatactcccaaggactgtttccacttgttaccctgactttgtgtttcctcttcgtttctgacaccatagtatttgtctttatttcaagttttgctatcgtattagaaaaagatggtagtctgaaattggagtttatgagaatttagtaaaaggtcaaagatgttaactgggaagggaaatctcagttaacaggagatgattgagtatgctggagcagttggtgacaccagtaggcttaaagggcaggagagagagtttatcagaacagggaataaatacccagacttcattctccacttcctctgtctcctgccactgtttctcattgaccgaaaccaagaaaaaaaaaaaaaaaacagaggaccaggaaatccattcatattgttcacatagattaacttcccaagcacagagggtagtgaagggtagagagtagatctagagggccaaagaaaagatatgtagcacttttcggtattaaattcacctggcattttatccagaatatctgtgctgtggtagtacaaatggtaaatgttcatttcagcttagtctccatattgttagtattaaaatttcttactaagaactagtctttttaatctcactctccttgtacatattaacttctcaatcctatcaattaacttctttggtgatttttttaaattgtggtaaaaaaatatacatggtaaaatttaccattttaaccattttaaaatgtacaatttagtggcattaggcacactcacagtgcgtagcataaccactatctatttctagaaattttcatcatcccagacagaatctctatccccatcgaacaactctatcttctcctctccctccatccatggtaacctctattctactttctgtctctatcgatttgcctattctaggtacttcatataagaagaatcgtatggtatttgtccttttgtgtctggcttattctactttgtgtaatatatttaaggctcattcctttctttgtgtgtatcagaattccactcctttttatggctgagtaatatttcattgtatgtatataacacatttaatttatctgtttctttgttgctggacatctgggttatttctacccttttgtctgttgtggataatactgctttgaacactggtgcacaagggttgatgaatttttaatgaaatagttttgccttgaagtaattgtatgcatgttatatgacttgcacctgaaaaaccattttaaaactcatgtagtactagaaatagtatttaattttttaactgttgaatatgttgataactgatgtatttggtttaaaatgcagagggaggggaaagaaagtaaattgaagtatttttaaagatactttattcggtgctgattttctgatttagaagagcacatttctgtcatcttaatatcatttgcttagtactatcctgaatggtccagaattatagtagcacttaatattatcccttactgtgttcaagtatatttcaaaattttggcagaaaatatgggtcccaaagaggaaaaaagggaaaattcgagtagtctgtttagtttctatagtaacccttcaaacaaaaaaagaatgttagtaattgcttttctctaaggtgtatgttttttttttcctcctggggaaaactagctaaactgtctactactttcctactctttgttgttatgaagtctctcttttctccttttctcagtcttaacaattggcttcctctgactttggtgtaatagttttgtggaacttgataagtgagcaaagatctttgtcttaattctgtcaacttacagttgtattttcgaaaaagattgtcagacggatactttagaccagcatttttattttatatactagaaaattgaaacccagagaattaaaatttgtgttactgtgtagggactgggctgactgatattagcttgattctaagttagtggaacctctggaagagactttgtaaatttgtttaagttctttgtagattctggatataagccctttgtcagatgggtagattgcagaaattttctcccattctgtaggttgcctgttcactctgatgagagtttcttttgctgtgcagaagatctttagtttaattagatctcatttgtctattttggcttttgttgccattgcttttggtgttttagtcatgaagtctttgcccattcctatgtcctcaatggtattgcctaggttttcctctaggatttttatggttttaggtcttacatttaagtctttaatccatcttgagttactttctgtataaggtttaaggaagggatccagtttcagctttctacatatggctagccagttttcccagcactatttattaaatagggagtcctttccctgttacttgtttttgtcaggtttgtcaaagatcagattgttgtagatgtgtggtgttatttctgaggcctctgtgctgttccattggtctgtatctctgttttagtaccagtaccatgctgttttggttactgtagccttgtagtatagtttgaagtcaggtagcgtgatgccatctcctttgggttttttgttttgtttttttttttctgcttaggattgtcttggcaatgcgggctcttttttggttccatatgaactttaaagtagttttttccaatgctgtgaagaaagtcattggtagcttgatggggatggcattgaacttacaaattaccttgggcagtatggccattttcacgatattgattcttcctatccatgaatatagaacgcttttccatttgtttgtgtcctcttttattttgttgagcagtggtttgtagttctcattgaagaggtccttcccatcccttgtaagttgaattcctaggtattttattctctttgaagcaattgtgaatgggagttcactcatgatttggctctctgtttgtctgttattggtggataagaatgcttgtgatttttgcacattgattttgtatcctgagactttgccaaagttgcttatcagcttaaggagatttggggctgagacaatggggttttctaaatatacagtcatgtcatctgcaaacaaggacaatttgacttcctcttttcctgcttgaataccctttatttctttctcctgcctgattgccctggttggaacttccaacactatattgattaggagtggtgagagagggcatccttgtcttgtgccagttttcaaagggaatgcttccagtttttgcctgttcaatatgatattggctgtgggtttgtcataaatagctcttattttgagatagcttccatcaatacctagtttattgagagtttttagcatgaagggctgttgaattttgttgaaggccttttctgcatcttttgagatactcatgtggtttttgtcgttggttctgtttatgtgatggaatatgtttattgatttgcatatgttgaaccagccttgcatcccagggatgaagccaaagtgattgtggtggataagctttttggtgtgctgctggattcggtttgccagtattttattgatgattttcgcgttgatgttcatcagggatattggtctaaaattctctttctttgttgtgtctctgccaggctttggtatcaggctgatgctggccttataaaatgagttagggaggattccctcttcttctattgattggaatagtttcagaaggaatggaaccaggtcctctttgtacctctggtagaattcggctgtgtatccatctggtcctggactttttttggttggtaggctattaatttttgcctcaatttcagagcctgttattggtctattcagagattcgacttcttcctggtttagtcttgggagggtgtatatgtccaagaacttatccattccttctagattttctaatttatttgcatagaggtgtttataatattctctgatggtagtttgtatttctctgggatcggtggtgatatcccctttattattttttattgtgtctatttgattcttctctcttttcttctttattagtcttgctagtggtctatctactctgttgatcttttcaaaaaacgagctcttggattcactgattttttgaagggttttttgtgtctctatctccttcagttctgctctttgatcttagttatttcttgtcttctgctacattttgaatttgtttgctgttgcttctctagttcttttcattttgattttagggtgtcgattttagatctttcctgctttctcttgtgggcatttagtgctataaatttccctctacacacggctttaaatgtgtcctagagattctggtactttgtgttttcgttcttactggtttcaaagaacatctttatttctgccttcatttcgttatttacctagtagtcattcacgagcaggttgttcagtttccatgtagttgtgtggttttgagctgagacatccgctgttagtctgatgggcttccctttgtgggtaacctgatctttctgtctggctgcccttaacattttttccttcatttcaaccttggtgaatctgacaattacgtgtcttggggttgttcttctcaaggagtatctttgtggtgttctctccatttcctggatttgaatgttggcctgctttgctagactggggaagttctcctggataatatcctgaagagtattttctaacttgattccattttccccatacctttcaggttcaccaatcaaacatagatttggtcttttcacatagtcctatatttcttggaggctttgttcctttcttttcactcttttttctcttatcttgtcttctcactttatttcattaatttgatcttcaatcactgatatcctttcttccacttgattgaaacgactattgaagcttgtgcatgcatcacgtagttctcgtgctgtggttttcagctccatcaggtcatttaaggtcttgtctacactgtttattctagttagccattcatctaaccatttttcaaggtttttagcttccttgcgatgggttcgaacatgctcgttttgctcggagaagtttgttattaccgaccttctgaagcctacttctgtcaattcgtcaaagtcattctccatccagttttgttccattgctggcgaggacctgcaattcttggaggagaagaggcgctctggtttttggaattttcagcttttctgctctggtttctcccctctttgtggttctatctacctttgttctttgatgttggtgacctacagatggggttttggtgtggatgtccttcttgttgatgttgatgctattcctttctgtttgttagttttccttccagcagtcaggctcctcagctgcaggtctgttggaatttacaggagttctactccagaccctgtttgcctgggtatcaactgcaaatattgcagaacagcaaatattgctgcctgattcttcctctggaagcttcatcccagaggggcatccgcctgtatgaggtgtctgtcggcccctactgggaggtgtctcttggtcaggctacacgggcgtcagggacccacttgaagaggcagtctgtccgttctcagagcttgaatgacatgctgagagaaccaccactctctttagagctgtcagacagggacgtttaagcctgcagaagttgtctgctgccttttgttcagtatgccctgcccacagaggtggagtctagagaggcagtaggtctagctgagttgcggtgggctctgcccagtttgagcttccctgtcacttagtttacttactgaagcctcagcaatggtggacacccctctccccgccaggctcctgcctcgcaggttgatctcagactgctgcgctagcagtgagcaagcctccctgggagtgggacccatggagccaggcacagggtggaatcccctcgtctgctggttgctaagactgtgggagaagtgcagtatttgggcgagagtgtaccgttcctccaggtacagtctgtcatggcttcctttggcaggaaagggaaatcccccaaccccttgcgcttaccaggtgaggagacaccccagcatgctttggctcaccctccatgggctgcacccactctccaaccagtcccaatgagaagaatcaggtacctcaattggaaatgcagaaatcacccatcttctgcgtcgatctcactgggagctgtaggctagagctgttcctattctgtcatcttggaagcgacttcgaaattattatatacgtaatttatctcctttattctcttaatgtgactaattatatcgattgattttcacatgttcaactgaccatgcatttctagaaaaatcccagtttagttgtgatagatattgctagattgaggttgctaattgtttaggattttggtatctatagtcatgagtgatactgaccatttttaccattttaagtatataattctgttgaattctatatttttttcttataatagccttgtcatcttttggtattagattagaagtttatactctctttataaatgagttagcaagtgttccctcttgtcctactctctagaaaactgttttcatttgaaatttctcctaatcactgtatatttccatgttaaaaaagtaatcttaattgaaaaggtacttggctataacacatatctgatctaaatttgaaagtcttagtttagatgtcatttagaaaattatttgaagagagagagaatgggttgggcgtggtggctcacacctgtcgtctgagcactttgggaggccgaggcaggcagatcagctgagatcaggagttcgagatcatcctggccaacatggcaaaaccccttctgtactccaaatacaaaacttaactgggtgtggtggcgtgtgcctgtaatcccgattcgggaggctgcaacaggagaatcacttgaacctgggaggcggaggttgcagtgagctgagatcgtgccactgtactccagcctgggcgacagagcaagactctatctaaaaaaaaaaaaaaaaaaaaagaaaagaaaaagaaaaagaaagaaagagaatgaaatggtaaggaccatatggacaaaggaccctaatttaataattttaaagagaacacagagaagcatcttgatcctttttccatctccaacactgatatagctttgttcctagaaattaaacttcatactatgtattgataaaataatacttaatgataagataaatatttctatcccactccagtggcccaatttatgtcaagtaaaactaatgaacatatagatgctaaacacatgtaatgtgtttttgttactgtacaatcatgattttatattactataagttttttggcttaatttttttgttgtggtacaatatacacaacataaaatgtactgtttttaccattttatgtatacagttctgtggtattaagtacattcacattgttatacaaccttcacaacagtctccagtattttttcatcttccccaactgaaattctgtatccgttaaaaaataactcaccatcttaatattaaatcttccaatgtatgaacactggatgtctttccatttatttgtgtcatcttaattttttttaaagatatttcatagttttcattatgtcttttacttcctcagttatgtttattcttaagcattttattattttagatgctattgtaaagggaattattctgttaatttctttattgtttgcttttaatgcatagaaacacaactgatttgtgtatgttggtgttgtatcccacaactttgtggaattcattgattagttctaaaagttttcttggaatctttagttttatacatatatgatcatgtcatgtgctaaaagacataattttactttttcctttccaatttggttgccttttatttcattttgtctcctaatttctctggtgaggactttagtagtttttgaataaattttccaatttattttgaaaatattagacaatattttgaagtttaccataattatctctttttataattttcttctcaagggaaacctctaacattcttttggctgtaagtaaattctgtacagatagccaaagacatattgacaaactggccctttattgcttttactttttccatgttagttgtactttttatactgttttttttttctatcttaaatatttgttaagtcaaacactatagattacaaataaaatgattcagactgggagacttccactgacacagaagtaaagatgtcaaatagtgattatattgtttcagtgccatactggatgtgaaatataaactttccatcaccattcatcactcattatctttattaaaggataaccccaatttatcttaagtatggttcaaagtaggttctaaacatagtcttcttcataatatagatgttgaataattttggaatactaactcacattatgattaatttaaatcacatttattgtggtacatggcatagacatgcatatgttcattaagtcactacacatatttttatgtaaatacgtaaaactatatttacaatatgagtttgtattttcagtttgttttttgtccttaatcattttaaacataattattttcttttattttttatcagatctggtatctgaacttctttagagttgaatctgaccacttgttgttttcttaaatcttgttcatgttggattgttttctttggcactgtgtaatttagtgttgggtgattctcatcaatggaacttcttctatgaagcccttacatggtggttgagggcctgtcctctgacaaagacattttatgtgtttgcttctctaagggacttcagcagctgcctctagcctgggacccctatactgttaatcttacagctagaagttttttgaaacatttaggcagtatgaaatcaagtccttaaacctacttgcactttagagttgtttttaaaaattttctggggtaactttgttgccctacttaggctgagatagatattgcttttttattgggtttattctgttgttttttgaatttcttaaattttattcttagcttattaatattcagtattttctttaaaattgattgatgaaaaggcggttgaggcgtctggtgagtagtgcatggctaggaatagccctgtggtgatttggaggatcaggcaggcaaacctaagttattaagacatagtcctttatcatttgaggaatttataatattagtgatggggcatggatgtgcgtataaacataattccaaagtgggctgggaaatttagcccatagttggattaccgttactcacagacaactttgtattatagaagggagagcaaaatttgggaatacagccacctgtttctgccacactcactgttgcattggttttaaagataaataaaactttatattttatgaagaacatactgcactgtacttcagctaggtgaagttgtcaaatttttgttgaggtcagtggtctagaaagtggaacattatataattatactcattaaaatttttatgctattttgcttataggacaatacaacaataaaaactgccattaaaagcactaacattagactgggcatgttggctcacgcctgtaatcccagcactttgggaggctgaggcgggtagatcacgaggtcaggagatcgagaccatcctggctaacacagtgaaaccccgtttctactaaaaatataaaaacttacccaggcgtggtggcaggcacctgtagtcccagctacttcggaggctgaggcaggagaatggcgtgaacccgggaggcggagcttgcagtgagccaagatctcgccactgcactccaccctgggcgacacagcaagactccatctcaggaaaaaaaaaagcactaacattttgatgattcctcttcatgacaagtaaacaaagcaaacacatacatacgtacacaagtacacacacatccttcccttacaggatactttcataacctgtatgtctttgggaaactgttataacaacataaaatcatattttggatctctgggttttcagtagtttcaataaatgtgattttaaaggattatattctgttgacaaaattaaattcctctgagttgtgattttaggcaaattatttagtgtttttttcattttaactttttctgtgtatataaaatgtttttggtaacgtcttccttaatcacagcagtagtataggaagtaatttcaaagctgtagaataatctaaaattctgagtgaatactagaatatttatttacaaataatttatttgtaatatatataaatatatatatttatgtaatataaaaatatatttatatatttcatatataaatatatatatttatgtaatataaaaatatatttatatatttaatatataaatacatgtatttatatatttaatatatataaatacatgtatttatatatacatatatgtatgtatttatgtatcatatatgtatatatttatatatacataaaaatgcatatatacataaaataatatgtatatatttatatacacataaaatacatatatacataaaataatatgtatatattttatatttaaatataaaaatatatttatgtaatataaaaaattattacaaatatttactctacctaaagtaagaattgatatattaactactcaatgtttggaagcttagggtcatggcaaagtgtgacaagcattgtttattgattcaagaattaaaattgctttattatcagcgttgttaaaaaaattaagcatgaagtggttccttttttaatgtccagtaactgttgaacatacattgataattgaaaagtgaatattggactgagagattgtttggcatcaacttcagagttgttgacagagtttgctgtagtagcaaaactcttgtcagtttttcagttattcaagtgcaattaacctatgcagtaatctacctcaaattattatgcaaacaaccgtttagatagtatatttagtttgaatttactcaattgctatttttaaaatttcttgtaattgttttaaaactcctgaaaatacttatgtcatttcatatttttccttaaatggttttgttcttaacatttagagagaaacttttattcagaatgtagaaatcataacatttaaactatcatcttatttgaatatctatgaaaaaaataaatatatcaaaacaggttagaaaaatgaaggttattgtttagccatcacataccattcaacacaatattttgtgtatgaagcctttcctatttcaaaatattcatataaaaatgtctttaaattattggctacttgatttttaaaagctcagatagttttatcatgtaaatataagctaataatctgaggttagcttacatttcttgtgttacttgtattaattatgtatctggggaacactttgaaattgcaggtttgatttttttaaattacaatttgcattcaaaaacaatcattaaaatttttaaacattttactattaaaacattgtttttcttgcttagttgggtcaaaactattgaatatagagaacttactgtaaatgaatctagtttaagaaaacacattctagggaaagcattaggagatatacctaatgtaaatgatgagttaatgagttaatgggtgcagcacaccaacatggcacatgtatacatatgtaacaaacctgcatgttgtgcacaagtaccctagaacttaaagtataataataaaaaaaacaataaaaaagaaaataagctcatgaaaataaaaaaaagaaaacacattctaacaattgtttgtattaaatggaaatatttgtttatatgatccttagatgatttatactttaaactatgagtaattcttttcatgctgacatgttgatggggagcactgtacttttgtgcacatatagctgcagcttcctgtgtttcagtctgagtcatggtaaagtgggaaatatgagtttgaagcttaagtactgagcttaaaacacttaatcattttttcccactcttgcattgaaatagtgggagcaaaggtagttgagaccacagcaggccacttgttactgttgacttaagtacaaacagtggtcgaagtgtttagccctttgggaagttttgtaattgaacaagaatgcaggagttattttgataagatagagtagcaatggggccaaaactatgatcatccttaagctctgaagcaggccaaggatgaagggatataaagtgtttgctcttccaaataaacaaagataaattcacctaggaaaataaacttagcatttggtcaatttgcaacaaaatggtaaaagaattgaactgtttattttagaacttggcctaaggatgtatgggaaaatagttcagcatctccatttccggcctgattttcacaacagatttggaaacagagcagaaaattaatgcacaaacatgtttaacaataccaaacaaaatgctgtaaatccaaaatgaaaactgaaactgcatgaggaagtacagcaaagcttttactgaggagtgcttactaaatttgcagccacagttttcttagcattcttaccaagtataccaagtagtgttaaaaattgaagtcttagtgattcgagatgttattttctctcagttctccatccttggaatatgatattcttctgtctgttggaaggagggtttaatttaagcatacttctactctataaacctatacataaagaaaggctatatatattgccttttatttaataagcatccttatctggaattagtttatgctttttattagatgttgtgttgcattagacagctaaccaaaaacctgatttttttatagcttctcaagttgtaggaatttctattgtagcagatttagaactacttattttgtaaaagcatttatatgaaaactgcacaaacagtgagatatttgctttgcttggtgtatttgggacaaagagtaactatactgtcttcaggtttaactctataattttctctaatagtaaatcccagaacactgttactttgctatgcttggtgcctaagtgttcttgcagtaaacacttgcctgtcattctatgaaaatcttccccattgggcctccttctgaggttgcagggaaattgaattttcttctgactgaaagatgttataaaacaatgaggttaaaataaaagcctcatgtaggagctgaatatacctgtgtttagatggcatgtctgtggtaatgagagccgggactttggtttgttttgtacaggattttaattatcattcctgcttttaagtgtttagagattagtggcttctgctctgacaacctgtctataaaaaatggaatactgaccatattatattgtctttgtttaaattttaaggggtattttgttctgacagttaactactggttatgactcgttagcacaggaaattaatatttttgtttgagacattcaaagcaataaactattggaggttgaggatatacggcaaaacaaaacgtgtctgaagttagaaagatgagaaaatgagaattctataagaatgtgagtgaaaaatttcttaagcattagttcaacttgataatgataattataactacaatttatgaactattttctatgtgtatattcttcattcacattcatatttctatttaatcttaactgtatgagataaatatcactataataaccattttacagaggagtgtacagttaaactacttgcctcaaatcacttgactggcatctgacttcgttaacccagtacaccatactgcctgccagactaagcttaactaagtatctgtaactgatatgtaaatatatatacatcttttaaacaaataagaatgttatattgtgtttgatcagttttcagagtatatgggtttaagctcgcaagttttgtttgcaaggtttaaacggacagcaaagtttgggattttaggaacccaatacttcatagctaatcctaaaagaactcaacatatcaatgattgcagcatctcttctgcatttgagactgaagctgttcaactttaaataaaagggtttattttattctggcctgctaaaagctgctgaaaagaccaaaaacaaacaaacaagactttgacagcaagttcgttagcactgactttaggaccttatacatattcagagttcagtatgtatttgttgaatcggataagcttatgctctattccactaagaaagctttaaccatataagacacttaaaaaaatctattgtcaaatctactaatttttaatgtctccttaattaacatgcaaggcatgattaatattttgctgtttcttaaactgataatcactttgctatagttattctagattccattataaatactctatagaaggggtagacaaatatttttctgtaaagggctggttagtaaatacctttggactttgtggattgtagcttctctgtagcaactactcaactctgctgaaaagaagtcatatgcagtcagtacatgaacggatttggctgtgatctagtaaaaatttattccccaatacagacagattagccccttcactgtagcttgcagactctactctataggaacatactcattggtttaatcttaaccttttctagatcttaactacttttagaggaagctggaaacatgcatgtgctttctaacaataaaaatcatttgagaagtgtatgtttatacattagcattatgtattggtattaacatttatatgattatcatttgcatgtaagatgtgaaaaagttacaaataataatttctgattttaatttataatttgtattttctgttatttttgtttatgttacaaagtaagatttttttttctcctcatcccagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacaggtacaggattccttttctttcttccctccctccctctgtccctccctccctccctccctccctccctcccttccttccttcctttcttttctgtctgtctgtctgtctgtctgtctttccgtctgtctgtctgtctttcctttctgacagagttttgctcttgttgcccaggctgaagtgcactggcgtgaccttgcctcactgcaacctcttccttctgggttcaagtgattctcctgcctcagcctcccgaatagctgagattacaggcgtgcaccacgacacccagctaattttgtatttttagtagagacagggtttctccatgttggtgaggctggtcttgaactcctgacctcaggtggtccgcccacgttggccgcccaaagtgttgggattacaggcatgagccaccatgcccggcctggattgcttttcttctttactgaaaagtgcaaatattaaacgctattttggaagaaatattaaatgtaatttattattgtcatttataattaaataattattattagctctaattcaagtaatttctagttgcagtgctaaaatgttgaatcttattaacattaaaggtttacgtgtacatattttccttgactttgtaatacataaattttgtcctgtttgtattaaaattcatctaaaagaccatgaggaattttcctcaatggtcatattgatacattatagtattgtcactaaaagtattgggaaaatccttgactgatatcaaatataacactccagacattaactgggctttcccctttcttgaaataaatgtcttatcttaataaacaggcctatgctgatttgcttattattctagaagcttttgtgatctcagcgcctctgtacatatccagcatgcatttgtcaatgtgaaatgtaaaatagaaagttttaatattaattgtgaagactgtgttgatattactgcttgtttcttattgcagaggtttgtatggtcagtgaactagaagatctcagtgcttccatagatgtccaggatgtatataccaaagtgaaatgtaaaatagagagtttcaatattgatcactatagaagcaggtaaataatgaataatgaatataagaaaatctgtatttttctttgaacaaagttaccataagactttttctattttaatttggctggttattaaaataaatactatacaggcatacctcggacatattgagagtttggctccagactattccaataaagtgaatatttcaataaaggaagtgacagaaattgtttggtttctcagtgtatataaagttgtgtttacactatactgcagtctgtgaagtgtacaatagcattatgtattttaaaatgtacataccttaatttaaaaatactttattgctaaaatgtgctaatgatcatctgagcattcaatgagtcataatcttgttgctgatggaaggtcttgtcttgatgttgatggctgctgactgatcggggtggtggttgctgaaggttagggtagctgtggcaatttttaaaaataagtcaatgatgtcatttgccacatggattgaatctttctttatgaaagatttctctgtagcatgtgatgctgtttagtggcattttacccacaacagaacttctttcaaaattagagtcagtcctctcaaactttgctgctgctgtaaaaaatgagattatggaatattctgaatcctttgttgtcatttcaacaatgttcccagcatcttccccaggagtattttgcatctccagaaaccactttctttgctcattcataagaagcaactcctcatccattcaagtttcatcatgagattatagcaattcagccccatctttaggctccactcctaattcttggtctcacattgttttcaccacatctaccattacttcctccagtgaggtcttgaaaccctgaaagtcacccatcggggctggaatcaacttcttacaaacatctgttaatgttgatatttttacctcctcccatgaatcatgaatgttcttaatggtgtctacagtggtgaatcttttacagaaggtgtttccatttactttgcctagaaccttcggaagaatcactatctgatacagtttggatatatgtcccttccaaatctcatgtggaaatgtgatccccagtgttggaggttgggcctagtgggagatatttgggtcataggggaggatctctcatgaatggcttggtgcctccccatggtgacaagtgaagctcttgatttcttagttcatgcaagagctggttatttaaaaagagcatagcatctccctgctctctcttgcttactctcttaccatgtgacacacctgttctgctttgccttcttccatgagtaaaagcttcccaaggcctcaccagaagccaagtagatgatagtgccatgcttgtacagcctgcagaaccacgagccaaataaacctctttcctttataaattacccagtctcaggtattcctttatagcaatgcaaaatggactaacacactgtagccttacagaatgtatttcttaagtaataagtcttgaaagacagaattactgcttgatccatgagctgaagagtggatgttagcagatgtgaagacaacattcatctccttgtatatctccattggaactcttcagtgaccaggtgcattgtcaatgagctactgctcatttacaaaggattttttttttctacacaagcagtcgttctcaacaaagagcttaaaatattcaggagaccatgctgtaaacagatgtgctatcatccaagcttagttgttcccatgtatagagcacaggagaagagtagatttaacaaaattcttaagggccctaggattttcagaatggtaaatgagcattatcttcaacttcaccagctgcattcacctttaacaagagagtcagcctgtcctttgaagctttaaacccaggcattgacttctcctctctagctatcagtctgagatggcatcttcttccaagagaaggctgttttgtctacactgaaaatctattagtgtagccaccttcatcagtgaactgagctacatcttttgtataacttgctgccacttatccttcagcacttgttgcttcatgttgcacattaatgttatagagatgccttctttccttaagcctcctgaactaacttctgctagcttcaaacttaacttctgcagctttcttacttctctcaatttatagaattgaagagagttagggtcttgctctggatttaacagaatggtgtgtctggtttgatcctctacccagaccactcagactttctgcctatcagcaataaggctgtttcactttcttgtcatttgcaagttctctggagcagcactttcaattttcttcaagaaccttccttttcattcacaacttggcacaagaagctttgttttctgcctatctcagcttttgatatgccttcctcactaagcttaatcatttttagatttttatttaaagtgagagatttgcaactcttctttcactggaacacttaggggccattgtagggttattaattggcttcatttcaatattgttatgtttcagggaataggaagacctgaggtgagggagaaagatgggaaatagtggggtcagtggagcaatcagaaaacacacagcaatgatcaattaagtttgtgtcttcaggacatcactgttcatgatgtcctgaaataattatgataatgtcaaaaatcactgatcacagatcaccataacagatataataataatgaaaaagtttgaaatattataagaattaccaatatgtgacacagagactggaagtcagcatatattgttggaaaaaacgctgctgatggatttactcaatgtaaggctgccacagaccttcaatttgggtaaaacataatatctgcactatgcaataaagcaaagcccataaaaccgaggtatgcctgtacttattctcaaagagggttcttaacagatacattgattaattttacttagtaattgttcatgtatggagtataataaaattttgttttataagatgacaaatctgttcataaatatatacattgccatattaaatgaaataagctacttttactaataatcttacataatttattttctatattttatatttgttaagatgcctgcaacccagttgatggctctgatttttgctgtatacgtcccatccattctctataccaatataatcattggtatagagatatacaatacaatcattggtatagagatataatcactgagatggagcaatagctcatttcctaagcactttgatgactctcatctcacagatgattattatgtatatggatatgataattatttttgtcatattaaacagtgacttattaattggcttttgataatagaatgttcaactctttagttcctttgaaatggtatgtgtctgtatcaaaatgatctttgcaagtgataatacaatattttggctgaagtaatttttaatgtcatgaatattacgtattatgttgtactttatccctgactgtaccgctaaatttatataaattatagatattcagataatttattaatttattaaaaacatacatttcttgtgtatgtggtatgcaccaagtgctatgctaaatgagtactggggatgtagtgtttaagaaaaatagcctggcatggtggctcacacctgtgatcccagcactttgggaggccaaggcagggggattacttgagcccaggagtttgagaccagctgggacaagatggcaagaccccatcaccacatacacacaaaaaggagctgggcatggtggtgtatgcctgtagttccagctgctggggaggctaaggtgggtggattgcttgagcccaggagttcaaggttacagtgagctatgattgtgccattgcactccagcctgggcgacagagcaaggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaattgttctattgattgcattgtcagatttatgttttagttcagtgcagtgttgtgaactttagacttatttgaaatagttatgtatgttcaatttcttaactcagaaaaattgaagagaacagataaggtgaacttatgttttccaggccaggggaaggttggcagtcaggacattttgaaggagtatttctacaatgcaaagaaaaatctgtggtgagacccatttagttactatgatttttgaaaatgtactttaaactgtttatcttgttatttcataaaataggactaatggttacaagaatttgagttcagaataaattcttattagcctgtttcttcaaaattacatataaatttaaagctatttattctttgaaactgctcctgttttgtaaccatcttcctgttataacaattaagtaaatttatcaaagaggcaaaggtaggcttgcttttgttaatatactttatctttaatgtactattgtgttgactttttggaattgtttcccaattcttatgtgagtttatgctggattgttctttaccataaactggaagtagtaattttatactaaaagcaattattttttgtttactttcattaacattgcttttgcagaagatggtccaggcagaggccatacctagcggttgctcaaacctaaatttatacaaacttgaggagaatttaaaactatccagatatttttttgcttatggcttttattgctttttgtcttttcaccttctttgctcctgtccatcacttcaagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctgtaagaaattactttaaattatgctacacaactcccattaacaggaacccagagaaggaattgaatgattcatagagtcaactcttgatttgtgttttcctccatatcataaactttataaatgaagtataatgtaatttaaaatcataaaactgcttttccactaaaacctgtttctgggtcacttgcatgagtacagactaattttacctcaatataaggaaatcaaagtaggacattcattatatttttttaaattgtgcatgtattgaatgatcaagagttgaccaatactgcttttgtcattcctcttacgattcttaataagattgcctttaaaaattttttttctattattatgccattgttttcttacaactaattcaaagtaacttgtgtggtaccttcttgaatctgaacaagtttgcatttctgtcattgattaggtagatgaacacaaggctgtatcagtgacttttagacgtttagaaccttgacttttttaatggtacaacatctggatatgttcttaagctaattcttttaactgatattcttaaagttaactttgttcttaaatttaatttttaatagtgtatttgcatagcaagtgttatgttctgattttattttgagcttttactagcaatagtctttaatctttagtgcaggaaaaaaatgtgacttttgtgttggaggaagtgtttagatttattttcctctctttgaatgttcattagtgtctgtgaaaaacattcttaataattttaacaaatattcataaagaaaccgtaaatttatcgttaatgttcttcagaaattttttctaaatttataaattaaatgccatttaaaaagtttctttacttagtgttttttaacattttattttaaatagtataaagtattattactgtatgaaaaaatgatatttatattacctcaactagtattcactttttgccttatgttaagggagttaaggatgcagcaattaaaaaaaaaacaccctttcttcatgtggcttacctttcaagtatgcttacattccacgtttaaaatatttttccaaattaaaacatttatacattgaaataccttttatactctttacaggattcaaatgttgctattaataaagatttattatgagttagatttttttagattagtggtcagtagtaaccctctccccagtttagacacttagaacagacaacatcactgtgatcactgtggcctcttccactgggggtataccttaacaatccttctccatctgttattgctcattgtccagcaacatgctaataaaactggtagcacttttcttgctttactatacatctttttgtttttgagtgcagaaataaaaaagaaggggaatcaaaagagaaacagtgaaaatgttgggaacagtgaaaaatgctttgagagcaggctattattgggaaagatgattatactgcacaaccatttaatgcttactttccagggtttttttaatggtcaattaaaaaatacaaaaataatttattttcttatcttccttcattataaagtctaaattaaaagcaaaattagcagtgataactgaattgcatattttttcctctcaccatgtcagtgggtgataggcaacaaaatgagaggaagaaaatggaagcaattgaaatgtaggagtgatgggataatatagctcagactcattactgctttcctatttctcttttttttctgtttatgtgaatatattttcttctttttgctttgttccagttcacttctcctcttaaaaatctcctctttggaccctactaactttttcaggtgttggaaagaggggcagggaatgtggaatataacagttctcctctaattctatgctgagcaatttccaaaacaatattttatgtctattaattggttgaggaagatttttttcaagtgacattctttttgtacgttgaggaatacaaaagtatatgttttactttactcttttaaaagcatgctgttttactctaacttgtttatagtgtgcaatttggataggagagctaattgagatagttttaacaaaaatattgaagttatgataatttttttactctgttaaatgttatatgtgtactaatatagtagtatacccaaagattatgatttacaggatagtgataattagattttataaaaaatgcgttagctattgataataggcaagttctgaaagacaaatgttatattgttacatcacattactgtttaaatatgcagtaactgtttatttagttcagttatcaaagcatggtatcgatgaggcttcttttgtaggctctgtctttgtataaattagccaaattattgaaggaaaaactccattttcacaaatgttatatcctatctagtgaaggtaatcatctggcctattcagatttggtctcaaataaaaatatgtaatgtggttatttcaatttcacctgagtaaacaacccttctgtgacctgtgatactttttatgacagcctcttagtactcataatgaaaaattatcacgaaatgaaaagataaaatcaagatagtcttttccaacctatgtttttttgtttgagacagagcctcactttgttgcccaggttggagagccgtggctcaatctcggctcactgcagcctctgcctcccgggttgaagcgattcttgtgcctcagcctcccaagcaactgggattataggcatgtactaccatgccaccacatctggctaattttttgtattttgagtagagacgggatttcaccatgttggccaggctggtctcaaactcctggcctcaagttatctgcccaccttagcctcccaaagtgttgggattacaggcatgagctaccccagcctcaaattcttaatgttacagaaaatgcagaagtcacagaaatagccacaaaaagattaataacctccctcaagatctagaactggaactcaggattcccatctttagttcagtcattctaaccatcttagaagctttttgcccacatctgcagaattgatcagtcatgtgtttattaagaagtgtagggtaagaccaagaggtaaaaatactcactgaggtcattttcttctttccaatttttaaaaaaaatctttttaatgaactgtgtattgtgatttcctttttttggaacagacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaaggtattgtcttctgattttttttgtctgattttaaataattttcttctagagaccttagttttctgggtttttttgtttcttttaaaaaatatgagcagttggttgtgctttgtggtttggtatattttatagagaggaaatatagatattctacaaatcattaggaaatacatcagaatactatgtaactatctgacttcgttagtaggataagaaattgaggaaattttttcttcagggcttttgccagtaaagcatatatatactttgtgttaattgttttactaaactcaaatgttgtgttctgtgtatctaagagaactaaaattttttttaaaaacaaggtcaagcacagtggctcacatctgtaatcctaacactttgggaagccaagataggaggaccactggagcccaggagtttcagaccagcctgggcaacatagtgagaccccatctgtacagaaataagatattagcccaacatggtggtgcacacctgtagccccagcttcttagcatatcatttttgtaataaaatatttgtatacgaaccttatagtgcttaattaccaagctagaactaaattcaatgtattatacttaacagattcttaatacaagccagtttctactttttatgtctaacttttcttagaagctatcttaaaattaattactttgagatgtgaaattactattctctgaatatcctatattctgacagtggtatacagttgctttcatctgttcagatagtttgtagaaacacatgaatggttaagaataaagagttagtctttatttaccaattacaagtgataaacaactcgctaaccagaaaagtaagaagcagtatattcattgcaaaggtaatgacctttatgctttttccttattatataggagcacctaatgaaattttagagaatgtaatttacattaagtttacataggttagaaaacagaaatctacgtttttatacagataattccctgaggactgtagtttcagttataataacatttttccacaaccttggaagagacacagacataaaagattggggagattgtcaaactgtttttggcattacaactgagaatgggaggaaaacaccatggaaacaaaagtagattgtctttattacacaaaatttatcagtgttttgggagaagaatttggggtaggtcattacatttaataaagaccatgggctgggcacggtggctcacgcctgtaatcccaacactttgggaggccgagtcgggcagatcatgaggtcaggagtttgagaccagcctggccaacatggtgaaaccccagctctactaaaaatacaaaaaattagccaggcgtggtggcacgtgcctgtaatcccagctacttgggaggctgaggtgggataattgcttgaacccaggaggtgtaggttgcagtgagccaagatagtgccattgcactccagcttgggtgacagagcaagacgccatctcaagtgggaaaaaaaaaaaaaaaaccataatgttgcagtatctgtaactattttattaaaataaaattacagaagttttatatctagataaaaataagaataaagttttatactatataatataaaaaattctaggtatagtttttatacaaggatattgttttccacaaatacctctctgattgttataaaacattcatttttctaacttgagttcctgtatttcatttaaaatatgttagtaggcttttatgatttcctgaatatttcctgaagtgtttgttttatgttccccattccttaattgtaaaattattttcagtttaatgcaaacaattaggaaggccaaaatttcattgaaacataagaaaaaatgtgatattagaggtgagagggtgggatgaggtatagaaaaatacagggagaatctctatgaaaaaagctgaggaaatagtgagaggctatagagacagaaaaggaagtaaagcaacttatctaattggtagacttttttactaataaagaaatgttgacgatttataaatgattctcaaattttatgatgtaattgtgtctgaataataattgtataatggacactaaatttagtcatttatcacatattattccctacactgttttaatttagggtttccttcttgaaaacccatttcacaccacaaaatatcaatttcagtaacaaatttaaattttagaagacgaaccaaatgtgtatgattcattgcctatttattaagttttaaaacttgaccaagaatatgatacaatatcagtgtgttgtttttttctgcatctttggcagccaggctgagacttttaaaatgggtatctaataatgtatacactggtaaatctttctgagtcagacatagcggctcctcaatgtgggcatttgatctgtattcaaaatttgctcatttgtcttaaaatatcttatctatctgatgtcctgaaagcttctgaaagtctttggtatttgttagtgaggaatattttcacaataaattgctttttcattgcaattagatcttcattgcagagcttctttgactcaaatttttgtggcaatacctgtgagagaaacctacatgactgacttgttttcaccatccatgtcagtgttcgtcatagcccttaggtgttcttcactggataggtcttatttatagtgataaatgtttccttctaaggcaaaatttgcctataaatgtaaatagttttcattgttaatttggaaaccttgttttttctcttttttattgtggtaaaatatatataacaaattttctactttaatcattttaagtatataattcagtggcaataattacattcataatgttgtgcaaccatcaccactatttccaaatgtatttgtcaccccaaacaaaagctctgtagccattaagtaatagctaccttcatcttctggtaacctctaatctattttctgtctgtatgaattttactactctagaaatttcatgtaagtggaatcatacaatgtttatccttttgtgtctgtcttactttacttagcataatgttttcaaggctcatccaagttgctgcatgtatcagaacttcattccttgctatagctgaataatattgttttgtatggatataccacattttgtttattaattaatctgttgggcagttgggtcatttccacccttttttggtttaatgtgagtaatgctgctatgaacactggcatggaagtttctgttagaggccctgttttcagtttttttggggtgtacacctaagagtggaatttttaggtcccgtggtaattctgtttggaattctgtttttgaggaaccaccaaacttcttggaagcccttgtggattagagcacgatttgtggtattttctgaacaatgccaatgtgcaggcatagttcagtcaacaagaagagcaaagggagctcacgcttagcatagcagcacctgtgtgccgagcacctgagcagctctgtggtgaggcagaggtctgaagttcattgtttaactctagctttattttctgtgatacttaccaatggtttattgaaacaagttatgtttcactgatatgtttgtgacaaaaagattacaaatcaggctatttaagaaagaagaggaaaaaaaagaacaactttattttctgtggggcttttttagtttgtttatatgtttttgttttgggcttattgtgttataaacattaatactacatatcacacagttttattgtttcccattgagttgcttcaactaggaaaatccctcaactaattgtaattgcagaaatatttccagacttctgccatcttatttttaaagctgctgctgctgctgctgctgctgctgctgcttctgcttcctcctcctcctcctcctcctcctcctgctgctgctgctgctgctttttcttctttttttggtggtggctgtggtgggtttttaacatataatttcagaattcaggtgcctaggtacttcctaaggtcaccttgaataagagtatgtgagattggggaaggtttttatagttgtctttggaaaacataatttcttttgtttttctgtggactttaagtggaatcctttgcaaatatgcatatttttagcaacaaacaactttttagtggtgtttttttttgtggcttggatgtatgtatctgtagaataaattaccagcaaaaggattgctaggtcaaaggattccatacctttaaaatagtaagcgatgtctaattgccttcctaaatggctgctatttcttactcttaccctaacagaagtttatttttagccttttgtacaaaggtctcattagtgaaaagtacgctactttttaaggagttgcttatcttttccttattaattaatacattttttgtgtattaatccttctgtctggcatatgtattgctcatatctttacttttttgtgttcagcctttgcatctctgtatctgtgcatgtatctgtatctttacttataattgtacttgcatctctatctgaggtgttataaatagccagactgtgtgcctaagctaagaatgcaaatacaaaaatgcatgccaaagtttcagattttgacacattatgttagtattttttatactttatctttcttctttgctactcttaatttaaataatcataattcacccatgaaaaggtcagaaaacaaatttttattgaggtaaaattcatataacaaattcaccattttaaagtgtagataattcttacattatattttatatgggagattggatgtgtccatttaatacatgttaaaagctataatgtggactgtggaaatcatgattgaaggagcaatttcattagaaataaatgtcattaatgactctagtaagttggagtcaagagtatactattcattttattttagaaagcctttacaagaaagtttgaataagatgattatcagattaattaaattaaaaatgtaggccaggcatggtggctcatgcctgtaataccagcactttgggaggccaaagcaggcatatagcttgagcctaggagtttgagactagcctgggctacatggcgaaaccccatcctacaaaaaatacacaaattttctgggcatggtggcccgggcttgtagtcccagctactcaggaggctgaggtgggagaattaattgagtccaggaggtcagggcttcagtgagttgtggtcacaccaccaaactccagcctgggtgacaggaggagaccgtgtctcaaaaaaaaaaaaaaaaaaaaaaaaaaaaaaagtatatgtaagttgttttaataagtgtgaaagaataactaaatcttgctacatcatacttttcagcagaaactttattataaaaatatcacagagcaatctgtgcttgtcacagagtaagtaatctgtgtcaaagatgagtggtaaaccaaatgcaactaaactttctattaatatgcataatggtcattgattatatgtttattgaaacgtttgtcttcaactgccagtatggcaataactgattaaaaacttttgttgaaagctgtcacaacagttttggctttatgaaagcataacattaaacagtggcaacttcaaatactcttgagacttcagatgttttactaaattgagtttattttgagaatcttaaaggaaagttgaagtctccaaaacacttttattcaggttggaattaagaaaagtttgttgtaagcaacattcttatattatctgacagttgcatgaaaattctggtctttattcaagctattggttactgatacaaactcctgatttcagagttgtttatagccttttcatatgccatacacaaatgtacattcatgcatctgtacacacacgtatacacactctcttgccccaagaaaagatgaaatctttcaggcttataatatacgctacattaatgtaagactctttaatcatatctaaatttcagttaatgataaaaaaattgaacattctactattttatttagaaaaatgatattgaaagtctgcttttcaacctggatattatttacattatgtgcagttactatcaggattctaaatctacaagtctttgacttccagcttaatctttttatttcacaatagatgacttttaaaaatctagcatgtctagaatgagtagttcctcatgaggctcaattttaaaaaatagagttaaagcaaggaaggaaggcattcattttcatgttgaaaatatttctagaaggaacatttcctcatatggtccaactattaaatacaggtgaaataacccaaaaaagagaagctgatttttttttgcggtgataaagtaactgaagaaatgactcaaggcactttcatgtataaatacatatttttattatttttttttacatctcggtgatatattttgataagttgaatactttctataataaaattaattattttaatctagtttatgaatgatctgcattaagtgctcttttttttaattataacttcatagtcagtataatctactgagaacacttttggccctaacagaaacagaattctgttcttggatctggctttgtatgtaacaccaagtacgtcatttctcctccatatttacctcatttactgcaatgtttctattacatttcagactttcatatggtgagtagtatctgtagcctggaagaacagttagcaaatatactaattgcacctttgtggtacggtttattctccaggcttactacgtaattgaggactgctgcttaatcagaggttttacccacatggaactatttgataaggttggcataaaatgcaagacctgtaaaatgtaaacaatgttcatattataaggacccataatcaaaccaaacctctaagtcatttgaaaatagtgcagctgcatgagaagtagttttctatttgatcttttgctatggatgtaaaaatactgtctttactgtgacatccgtatgctaatatttgttatgatagttcatctctttttttctccttttgctgtcccttctcccaccttcctactattttgcctttccctcctcccttcatggttatcttattctggttccttatttctctcactgaatatcttattcttcttatgtttttctgattttcttaattctgacgttctttccttggactaatctgaattagaccataccaagtatgtgaaaatatactgaaatatactgaatatactgaaaacaatacactgaaataatatactggaaatacagctggaaataatctcgtagcttttgcattctttgggcaccacagtttgggaaatatggattgtatgcctttgtaggcaggttctgttcaggatatttcttaggtcttgcagccagtcattttctgttctatttttggcagatggtagttccttgagagaaattataagttttaatatacgtttattttaagacctagaaagttgtatattgttaacattttttaaacagggtttatacagctactatagtagaatcatctgttggagaatagagagtaaaatgtaaatgtatttttttcatgtgtctgttggctgcataaatgtcttcttttgagaagtgtctgttcatatccttcacccactttttgatggggttgtttttttcttgtaaatttgtttgagttcttcatcactggccatcagagaaatgcaaatcaaaactgcaatgagataccatctcacaccagttagaatggtgatcattaaaaagtcaggaaacaacaggtgctggagaggatgtggagaaataggaacacttttacactgttggcgggactgtaaactagttctaccattgtggaagtcagtgtggcaattcctcagggatctagaactagaaataccatttgacccagccgtcccattactggggatgtacccaaaggattataaattatgctgctataaagacacatgcacatgtatgtttgttgcggcactattcacaatagcaaagacttggaaccaacccaaatgtccatcattgatagactggattaagaaaatgtgacacatatataccatggaagactatgcagccataaaaaatgatgagttcacgtcctttgtagggacatggatgaagctggaaaccatcattctcagcaaactatcgcaagacaaaaaaccaaacaccacatgttctcactcgtaggtgggaattgaacaatgagaacacatggacacaggaaggggaacatcatacaccggggcctgttgtggggtggggggagggtggatggatagcattaggagatatacctaatgtaaatgacaagttaatgggtgcagcacatcaacatggcacatgtatacatatgtaacaaacctgcatgttgtgcacatgtaccctagaacttaaagtataataaaaaaatgtaaatgtaatgaatggggccattaatttcccctttcatgccaaatagtccttagaaaagacattgaattcactgttgagttgtggaaaaagtgctgaacttcagccctaaatgagagcatacagtcaaatatcattttatttagtacaaaaaagagaattagaactgatacatccttttacctttttttgttttctgggattatttatcatagttttagacgtcattaggaggtagaacttttaaaggggtctggggttccaatttctaaagcaattttacagtagaagttattaaaattaaaaagtatctagaataacaggttgatatgttctcccatattgaatagttggtgttttccatcttcaacattgcagccatcatatttcttttgaattttctgacattttggagcttaaagtgatatactttgtgtgtgtgtgtgtgtgtgtgtgtgtgtgtgtgtgtgtgttgtatttaattattatttagcatgtaaatttaaattgctttgagaatttgtcactgactttgtaatatccttcaatatatttgtagacaacaatgaagtattaagaacccaaagctgaaaagcatttaggagaaatatgcagattgtgaagttagataaacatttggcttcaatattacttatatatatttaatatcataatttttaatgttgggagtggagttgtttttcttttctttgctattttaattgtgtattttaacaggaaaccacttaatgggtattaacagagttaagaaaagcatcaaagatttttattttaaacatgattttttttcattttactttttcttatttattggtcttatcttaatgtgtctctattccattccctcaaagatttctccttatgcataaagttatgtacagatccacagtgtattcatgaatctccttcttttgttacagctaatcaggcagcaaaagaagacactgtggttttgaagattggctctgttgccatggctccccaggctgacaatccccttggcagatctgtccttaggaaagatatttaccagtaagtttattttcttatgtccaatcttgcaacaattttcatcctgcaaacacatatagtggtcaataacttagtgtggcctgtagaaatatttctcattcaggatcttttgatatttaaaaccaggtttttctgattttcttcagttgtgggttttttaattcattcagacaaatcaagtatttctgtgaagtgttgatgaataacagaatgtaagtactaagtcaccataaaactgaagaagcatagtttggaaaattttagcagatgtcaaatttgaccaaatctctaatcacataagaaaacgaggtcctctgtagaaccaccacatcctactgtagtcatgttgtatcaaagtgaaacattttattaatttaagtgtaagctattatttgaaatgtaggaatgtggatgtcatatggatcaaagctataaagaaaagcaaacttctaaagagaaatttcacagtaaacactttctgtgaaaatgctatgctctggattttgtcactgagtatttgcaaaccacaccaagcatacatggacaactaaactggtgaacatatgtaatcaacatgataaaaataatatatgattcatactgaagttggcactgctgccagacagaaaagtacagttgcaaataataccaagtgagaaaagtcacagaaatacagatgaacaagtgatttattcttcttgctggtctgtttttcagatgttgtagtctcactcttctaaaaaataaattcctactgttctccagtaaatgttactgctaggaaaagattctaattttggtgattcatttaccatctagagggtgatggctatttttactttaaatagatctaggaactttatttctcatatttctctgatatttgagttataatttcttcctttgacttatgtatgtatgatctcttccttgtattttttttaggtatttaatagtattcaccccttaaataagtttttatgcagctagcttatatataatcttaggatttcagagcagaaagcgtctttaggaattatctaactcaacttccctgttttacagattaggaaactgaataaccaaaagaatactgtagttgtccctggtgaaagagtaacagagccaagattataattcatatcttttgactcccttaggatctagggaaatgattataatagaacataaattctatatgagaatactttaattttctaacatttggaaattctttcaggtgtctttatcttttctacttcagaagtaagtggtcctaaaatagagacctactttacttttggtgaaagaaatctaggttatattaagagatcctatcaccatcagtaaagtgaaccactgagataattcctttccttctgtaccctttccgctttctggcttttgcatgagttgtatttttactttctgggaacaattgtgtgaaattgtttttttagggtttccttctgtctgtcttgcaactttttttcagtcatctttactggtcttcctcttaaacaatctctttgctattagtatttcttagggtcttccttttattctttttttttgcccaactcttcttgggtgaggctctctgctcttttggctcaggacaacttgaattctaagcatgtagggtaacttggggtgaccctgtagaccaaggttagcaatatgtgttagaatgtcaaatgtaaaattctagatgctggatggcaaactcaacctaataatttttctttgaaagctcacattcaagtcatttctacataaacaaactaacaaaaggtattcatataagagtttatcaaaaatgtatcaagatctcagtgaaatgctgtatcatcgatatcaaaggagtaacagcagaattagaaaccacttttgagtgaatgatcagagtgggagtagctcagtataataaatgtatacacaaagcaaaagaccctgcatactagggctgattttattattcctatgattttgttaaccatgaaatctcagtgaactagatgcaaaagtccacatattatgtgattccatttatttgaaacgtccagaatagacaaactcagagagacagaaagtatattagtggttgccagggcctgcttgtggaaaggggagggaagagtgggaaaggactttgtcttgcggcttgggtgccagctcatcctcaatagaacagagcaccaagtagattcctaaggtttctgactccaggccctggctcctggacagcatctctggatgcatttgggagccggggaactcaccactctgaagggaaggacacaagcctggttggcttttctatctgctgattgctgagccctagggccttgagtgaacacaggccatagccaggcagtggttaccacgggcattgggtgggacccagtgctgtgctggcttcaagtctgacccagcgcagtcccaatggtggtggcagccacagtgcttgtgtcacacacacacccacaccccttccacagctccagacagctcagcacaggctgtgtttgtttgggagaaagtaagggaagagagcaagagtctttgcctggtaattcagacaattcttcgggatcttatccaagactaccaaggtggcacctgtacaagtctgcaagagccacagtgttactgggcttgggttactccctaatgcagatatggcggcaatgaccaaaaacttagatcacaacacccaagcttcttcaaataactggaattctttccctagaaaaatgggtacaaacaagcccagaccacaaaagctacagtaaatacttaactcttaaatgcccagacatcgatgaacattcataagcatcaaaaccattgaggaaaacatgagctcaccaaacaaactaaataaggcaccagggaccaatcctggatagacagagatatgtgacctttcagacagagaattcaaaataaccattttgaggaaattgaaagaaattcaaaataatagagaaggaattcagaattgtatcagataaatttaacgaagagattgaaatcatttaaaagaatcaagtagaaattcaggagctgaaaaatacaattaacatactgaatgcatcagagtctcttaacagcaaaattgatcaagcagaagaaagaattagtaagcttgaagacagactatttgaaaatacacaatcagaggagacaaaagaaagaatgaagtacacctacaaggtctataaaatggcctgaaaagggcatagctaagagttattggccttaaagacaggcagagagagtgataggagtagaaagttcattcaaagggttataatagcaaagaacttcttaaacctagagaaagatatcaattcaagtacaaggttgtagaatacaaagcagatataacccaaggaagactacctcaaggcatttaatcatcaaactcccaaaggtcaaggataaaaaaggatcctaaaagaagcaagcaaaagaaacaaataacatacaatggagccaggtacagtggcttgtgcctgggatcccaaccctttggaaagctttacgtgggaggattgcttgagcccgggagttcgagaccagcataggcaacatgatgagacttcgtctctataaaaaaacttaaaacttagtcaggtgtggtggcacacgcctgtagtcccactgttctgcaatctgagatggaagaatcacttgagcacaggaggttgaggctgtagtgagctgtggttatacccccacgctccagcctgggggacagagagagaccctatctccaaaaacaaacaaaaaccatacaactgagctccagtatgtctggcagcagacttttcagtggaaatcttacagtccaggagtgacatgacatacttaaagtgctgaaggaaaaacagttgtaccctagaattgtatacgcagtgagaatatccttcatacatgttgtagcagaaatgaaggttttctcaaacaaaagctaaaggatttcatcaacatgagacctgtcctacaagaaatgctaaaggtagttcttcaatctgaaagaaaaagacattaatgagcaatgagaaattatctgaaggtacagaactcactggtaatagtaagtacacagaaaaactcagaatattataatactataattgtggtatgtgaactactcatatattgagtagagagactaaaagatgaactgattaaaaataatacttagacagtacaataagatataaatagaaacaacaaaaagttaaaaagcaggaggagaaagttcaagcacagagtttttattttctctttgcctgtttgtttgtttatgcaatcagtgttgtcataagtttaaaataatggtgtatattaaatttgaaaaacagaaaactcctagggcacatggtactattctttgaatacgtagctgataatgtgtcatagggagtagttcattccttccaaagctaagaacagacctaggatcattaaatcagtggatgttacaatgaccctaattgcagctcaatagaatgaaaatctttcaaattataaaagcctaataataaatggggctttttgttcttactcatttaacaattattttgagggaggctactgtacatcaggcactattctagatactgggtgtatgtcagtttacaaaagaaagaaaaatccctgctctcacagaacttacattctaatgggagagagaattacaagctaataaataaatcatatggtatactagaatttaataagtgacatggagacaacaaagctgggaagggaaaaagaaatggagagttagagatggacagcatggcttagttagaagacacctcactgagaaagtgcagggatcctgaagcaggaagaagtaagagaagccagtggtggctggagcattgggtgccaggggaatttagcaggctgtgaggaaaacgacattatggaagatccatataggtcgttgtgtggactttggctattagtttgagtgagacatggttgtgggggaagaattatccacacatgcagaattttgaaatatgtaatgcttttattatttactaaatgtctgcctgcagaaagaaatgggggggtggggatggggatcaccagcagggactagagatatacatttaaaaagaggttaaatatacgtttgaaaataaagggagtcacaattaagaacaaatggaagtgtgacattcaaccctaaaagaatcatgttaagaattattaatatttttgctacttgagttaactgaatatatgatatgaatttcttttgcttattgagtagttgattttgtcatcaaatggaaaggcctcagagggtttgagcagagaagtgacgtgattctttttatacttaagcagattactcaggcaaggaaaggcaagggaaagggaaaagctattgctgtaatcttggaaaaagatagtggcggcttgggcaaagttagtagctgtggaggtggtgagaagtggtcagattctggagatgtttgagaggtagagccaagagaatttgcacatggggtttgagaaaaaggatacaaagataattcagttatatatggcctaaacaactaggaggatgaaaataactgaagaaggaaaaccgtaggaagatttgttttggaggattgggtgggtggagattaggaatttatttttgaaaatgttgactatctcaggagttaatgagctccccatttctgatgtagcagaggctaatcagccacatacaaggcttaagaggggtaatgatttatgtcaaattaaaccagtgattcctaaatttactgtgtttccaaatcacccaaggatcttgataaaatgtggattttgacttatgaggtcttgtttgaggcctaaaattttacatatcttctaggcttctgggtgattgggtgtgatactgttactgtgttatactgatatgccacttcagaggctacaccctttgtaggagatgattaaatccattttttttacaaaccttttaaacggagatcatttaaaaaatatatttttaatgaatgttaacaatttttaatgctaaaaatcaaaacactatgaaaggttctgtgagaaacattaaatatcctccattctcagtctttcccactctgtatccgagtttgctctcggtggattctttttatagcaacaaaatttttgtaaacttttagttgatagtggttaacttttggaatctgtgactgagaaaatgtaaaataataaaacacttctgttaactaacaccttatatgaatttgtactttgttactctcaaaagcatctgatccagtagaaaacaacagaacatacataacatgttatttattcagtcactgtgcaatgcgtagcccaggtatgtattgtcattggccctcccttaaccctttaccttctttacttgcctcctccttgcctgataatctacctggtttataactgccagctcctggataggatgatctctgtttcctttaaactcaatctgagattctcctattctgtgatgtgttcaaccatatccctgatttataccatagtcctgaagcactgtctgacctgaagttgtttctttatcttacacaaccccttctcctgagaaatttttcaggtccttgtctcaagccaaaagagaagcaagaaacagttaagtaagatgttataaaggcagatttttaaaaattacctgtggtgaaagtgttttttcataggctgattagagattataaacaaacgagatgaaaatatttaaatatgtttatagcttaagcatattaataatttaataaattgtctgatccaagtgaagtgatgtttacaactaattgatcatgaccagttacagatttcttcatttcttctccaattccactgcttcacttgactagccttaaaaaaaaaagttaataaacatagttacacttctcttatataaatgacatatatttcttagaagctttatgttgtgcaatatgctggtgtatcctctataccttattaactatagtttgtatggttgtttctattaaataatgaaaacaagtctcagaaccttgagccatgttatgctataattgctatataagaattacactggatttatattatacttcctatgtcttttctgaatatctcatttctctgattctgagtactatgtgtaagcagtttgacttgattttcatggtttttaatgattttctaaaaatagcttttattataagaaatagaatagccttattagttattaatacaatagggatctttgagacatttatgcccttcctttgcatgcattcattgattaattcatttattaaatatacattgattaatatttgcagctattcaacagacattgagtgcttatgatgactagacaccaatagtagatatatatttttgactagaacatatggtactgtatgacttcacagaactcaagacttcaaccacattatcttacaattacattgtaatttcattgtagttctgatagattctgtatcataataattgcatgctttgtctacaccacctcccaaaatgcctagattgatgaaataagtgaaattagaagttttgaacttgcaccctaaacttttttcatggtctcatttttatcattaagtatccttacaacattctgttctatcttccgaaaattactgtaagaagcaagaatgatcccagaagttccatctagatttgcaattttcacacaaaggaatagagaaaagtgttcataaatttcattcaagtttttttctttttagaagtaataaagagaatagaaatatcagcattaattattcatgagtatatttaagtaaatacattaccttttcagtacattttaattggtcttttttgcaaattctgtttatatcctgttttttaaaatattgattctttaaaaatttagcttatgatttagtcttctgattatgaaattaaaataagaaaaggtaaaataacattttaaaaatttataaataaattttcaaaataccttttttgaaaatacatctacccttattttaataaacctatataactaagacatttacattttttaaaataaaaagataatcgtgtttatttttaaaaaatcaacaccaaagtgtatgcaatactcctccttaccagggcttattctgaatggtaaccacctccttaccctgtggccactgttagatcaaaactcacagaccgtttgtctgtatgcgtgtgtgtctgtctgtcttaagtaatggaattgtactctgcatagtattctttaacttgcttgtatttaaactcaataatgtattgtggtcatctttcagtgtaatcatatttagacttgccatcatactgacctgtttttgagctgttttagacagcaaagataaaaaacttcatgtaaacactgctttctgttttgaaccgagaaaatattcatcactattaaagttcaattaaaacttaaaaactcttatatactatattgtgactgagacttccctgacctcaaactttattatacattataaaatgtaaaagggaaaaatgttgttttcttccgtgaaatagttaccagggcaattcctgaagaacaagtatatcagcacaaataggaaattgaaattattatagcttatgtgttctttgttactatttgaattacaagggcaaagtaattcacaattcaacactggtgtgtgaattaaaatatcacaggtgtttgggctttaacaaaccactcttaaacattgtttatcaattctctgctcaacacctgtcatagtgttcagtttttaacatgacaaaatccctgtcttttaatgcaaaatgtatcttcctctctgatctgaccttatcctatactttaaatattaccactagttgcttctttacataagacacttgttcaagttaaatattttgtctaatccaataatgcttattatgcgcctttctgtggctcttgtttatgtatgcattttcaactttcttgaaataacagctaacttccagtttagcctttcagggtttttgttacgaagaactttacattgatgggggtttgtatcctttaaaaatgttttttctttgatgttcaactctatttttaatttttaaaaatccttaagaatcgcatctattttttaatatcttacttaaatcttgctctctttttgaaatttttcataatcattttcttagaagtaatgtctccttcctttggccttctacagcaatggctgacctacctttatgcaattataatataataatagtaatagtagcagcagtaggctgagtgcggtggctgatgcctgtaatcccagcactttgggaggccaaggtgggcggatcacctgaggtcaggagtttgagaccagcctggacaacatggtgaaaccctatttctactaaaaatacaaaagctagcaggcatggtggctggcgcctgtaattccagctacttgggaggctgagacaggagaatcgcttgaatctgggaggtggaggttgcagtgagccgagatcatgccactgcactccagcctgggcaacagagtgagactctgtctcaaaaaaaaaaaaaaaaatagtagcagcagcagtagtagcagcagcagtaatagctaacatctattgagtgcttcctttgtgtcaaagattctgtgcattgctttcaatgcaatgcctacatctcggtcgaacctcataataatctcatgagtcaggtattatgattatctgtattttagaaataaaatattcagtctgtagacattcagtagcttctcctaggccacacgtaataagtgacagaaccaggactgtcagttccattgctcatgcactttaccactacatctcgctgcctgtatctgagtttcttataagatgtaccagctgtagtttaaccaagttatttataaccagtttatagcatgaagtttgaaacttatttttgaagtttcaaatttatattccattaaattttgttattatttaaatgttccaaaaaactagtaagtaccatttgtagtgcattctccttgtgttccttaaaatagtcttagctaggatggacttaatattataaccttcaaaccacaatttataatgaaaacatttataatcccagtgtttgagctctttggtccttgaaggtacttgaacatgcaatccgtttttagagaattttcatcagaatgtgcttaatactgcatttattctacaaatatagctccgtagctaatgattttgattgccatcaaggtttttctcacatctcttatgagctctgagatgagtaatgaccagataaatatttacatagatgttgtatctgattaacaaagtcaatatattttgtggcttttatttataggagatatttaaaagtcattataaaacagaagtgttatgaatcttttctcttttctcctagtaaaatttagttattaatctagttgtctcaaaattatgaaagaaaaagagatgttaaaacttttgttaaatatctctcttcatcccattgtatacttacatatcagtatttttataaattgtggtaaaaaatattggttttattttaaaacaattatgactattttcacatgtattttttatatagcaaaattatagcaaagttgactaagtatgttatgaaggcttctagtaacttagatttttttcttcccactaatcttgtgcaattgagaaatactgtgttcaagctacatatctgaatatagagtttatagaattagatatataaatttggaagtcatctaacagtatatatcgaccacctatatcattgctctgtcatattttataaaatattaacaaaagctcttcatacctattcaaatagattttttaaaatagtgattgtaacataatttacctcatacttttttcaagagtatttcatttgttataacagaactttaaaatattaaaagcagagctttttacttcggaggtatttttaattaaaaagttttttttaactttcatctttaacttgagagaagtatattcttcttgtaattgaacatttgtgaacttctgcatataggtttttgttcatgccatgaatatttctgggttttctgaagtcccttctggaattttatctgtgactaattattccatagctcctttttaaacatcgtcaattgtgaggtttttcaaccgttttacatttttttgcagacatttgctaatcctttttagtgcattcagtaccaatagatttgattctgatatgggttttaccttttctccatagataatttcattctcataaaacatgtctacaagcattatatgaaaactgcatagtaattttggcaaacttttgaaagacatcttttataagtgagacttctgaaaggtgtaccctgttctgtggcagtttaatccatgaaattttacctttaaagaattataaaagatagggagctgattcacttttcacccttagaagacatgtgttagtaaaattcttccagaagtatatacagaatttgttttccatctgcttattgctttttttgtgagcaacttttgcaacagtgtttgctctgtttcttactatgagtctgataacacaccctcagccacaggaagagtgtgaaaatatgctttatttttaacatagttgatgaaaaattaactttaattacaaatattcactttatttcattgtattttattgtattttttgtgttaaatatttatgctaacggctcaattttaatagcataaatatttaacacaaaaatacacacttcttcagcagaaatttactgttttatataacttagcagaagtttttttaaaattaatctaaaatgtattttaattttttaaatgcataatcaattcactgaggggtgtttttttttttttttttgagatggagtctcactccgtcggccaggctggagtgcagtggtgcaatcttggctcactgcagcctccacctcccgggttcaagcgattctcctccctcagcctcccaggtagctgggattacaggcacgcacaaccacgccggctaatttttgtatttttagtagagatggggttttaccatgttggccaagctggcctcaaactcctgacttcaggtgatccgcccaccttggcctcttaaagtgctaggattacaggcatgagccgtcgtacctggccaatttactgagatttttaaaatcatagtttactaaaaattaagtatcttattgaaggttttaaataaattgaccttgaggaactaccaagtgatccaaatacagatatttgcaagtgacataattgtttcatgcattaaaatcttgacagtagctttaaaaaaatttttaaactccaaattcatttctcttgttatgtatatactcttgactaatttttaaatggtcattctgacttttcatagggttaatgttcccaatatgaagtaacattaatgtgaccaatgaaattcatgattgagattaactaaattttttgtcttgttttacatatatactttaacagttgaaaattgaggaatataaccaatagaaaatcatagacaagattaacattcttttattgatgagcttaacatcattaacaattatgtttgtatgcttcaacacattgtgtttattttaaaataggaaaaccattcttttttatggacatgtttataatagcctttctttattcctgatgaatgtaactcaaggtatggcatctctcctttatgtatctttatggtttctcctaaaacctagcttatcatctttaacactgagctgtattttctagatgcagtgttaagattaaattctacaaatccccacaaaactgtttcctccttcctcctcccaacttttaatttcttcctaattatataaaggcattctcaaaataacctttgttttggtttttggcaaaggtatgtttcgtatctggtgacattatgaccctaatcctataatggttagtgttggtttcaaataattcccttttagtaagtcagagagagagagagattgggatagtaggtatttagattaacttccctaaaagctttgtttgaaaatattatcggcagagttttagtgcgtcatggtattctgctgatttagttgaaggctttgcatttacatttggccctcaccaaagtaactgcatcttttgtggcttcctgtagcaggatataggtttccatgaatatggtttctatttactgccaaaagctacctcaacaacagtgttgaaaatgacgataagttctaccatcataaatttttgaaatgttttttaaatgtatttacttttatattgccacttttatactttcttctagaaattcatgttagaagctacagaataatagaatgtttgggttcccatcataacagttttgtgttacgaatttggaaaatctattttatacttctttctaatatattttggttatattaagtacactggatatataatatcttactataaccattcctgctggtgtactttcattgaggcactaacattatcatgtgaaattattatctaaacatctctgagtttaaagacaagtgagagaaagcatagggtacctttaaaatacatctttgggacttctggaatatgatggctgttcaccataaccaccaacatataagacaattgtccaaaatatggtaaaacattgtgctactgtcttaagtgtctgatgtaaaggaagaattgcatttttctcattaataacaaagatcaaatattgtaacaaaagagtaacctgcaaatttattcctatagctattcatatagtgtaacctgcacatcatcataaaaggcttgaacagaatgaatggatggatagatttttcaaaaaatctttgaccaacttcaagtgtgagaaacctgtaaatgtgagaagcagtgttggctttgtagttacaatttcagaatgatccattttaccctttgttgactagtgtccattttcagccagccccctcatatcccctaaaccaaaatagaagctaactaaaaagaaaattaagaagcagacatctattaattaatttaatgtgcagaattaataataaattacctctacacattgtataagagcactgctaagccttggtaagataaaatgctgttaccaaaaaaatcctaataatttttacatgaaagcaagtaaataattattttccaaaatactaatttaaacaataagtcttaaatatatatgcttactttatgttgtattgtattctgtgttcactgaggtcactgtcctagaataaacactataattttgcctgttttgtgtactagaaatacttatcctgtttgaagaacttccatcctctgtggtgtagacagatagctcctcaatctgaaacattttccttgctcatcatttctaacattgaactttgagcaaaaaccaaatatctgaaaagcattctacattgagaaaggtaatgaaaaatacaaacatgatcctaaaaatgggtaaaaagtcagtgcatagctaatttttttctttttacttttttcattttttaaagtgagttacaacttacatataggaaagtatatttatcatttgtatacagttgaatgaagttttacatatatatagacatgttatcacaacccagcaccccagaaaccttactcattctcattctagcctgtatttggtagtgcaaagataatcattattctgacctctgtaactatgtattaggtttgacataactaactgttattatcaatgtttacattgtgaaaacttttatctcaacataggttgtcatctgtaaatctacttgaaataatttctgagccaatgtcagatcatataattcaaaatataaatgattttaatccaaattttttttttttttttgagatggagttttgctctttttgcccagagtggattgtaatggcacgatcttggctcactgcaacctctgcctcccaggttcaagcaattctcctgcctcagactcccatgtagctgggattacaggcgcacgtcaccatgcccagctaattttgtatatttagtagagacagggtttcaccatattggtcaggctggtcttgaactcctcacctcaggtgagccgcctgccttggcctcccaaagtgctgggattacagatgccagccaccgtgcccggcctgattttaatcagaatttaaagcacaattttagactttagttttaaactttaatatcaaataatatattatccactctggtattttccatgtaaatctctgaatgcaaccataaggaaaaaaattaaaaatccatatatgaagattaaacattataatttgtaacatcttcattcattagataaattcctagcatataccctaataactggctgtagcatgagcttttgagccaatttttatcaatttcacttaataccatagttatttagtgaaaaatgtcatatacatatgtgtgtggcatttgtacaacatagagtgcatagcttctgtaaaggaaataatgttttgtatcctgggaccccattatcctttaactgaattgactgtcatccaagtatgggtttgataaactgacacaacagtgaaaagaatccctgtcccatgtcagcttatcaaacacactgtggacagcatgtctttggcattaaacgtattcccagtcattaaagttctgaatagaagtcacgaagcttatgttcagtgagacacaacctcagtgtttccaggtgattttaagaacacctgataaaactgaggtatagtaccactaaactttaagaattttccaaaaactagggaaaaaaagtaacatgcatagagttacagaattgcagtgttattgttcagttcgatgatagaacttatattaatgagatatacagaaaagtaattaatatcttgtccttctggtaaaccatgtcaaattatgctgtaaatatatttatactgtagaataaaacaaaatcaaatatgttttgattttttaatcctttttttcaaataataacgtatatccacctggtaaaattgtccatcggtctgaatctctcactatttttttcccaatttcatttatttaatttgaaaatgtctatcatcaaaaatttagcagccttttttggaatagtgcactaaaatcatttgtacattgtccaagttaaagtataggcatgtttgaaaaagatttttaaaaatttattctagtgctgtaaatatatttgggtgaaaagctaacttctatggtgatgtaggtcaaaacgtttacttataataatacttcatttatacatatctataataaaatagttaaatctataacatttataggtgaatttgcctgattctatatcatatacaatgcgaaaacatctttcaggtttgttctccatagtttaaccctcaaagaagaaattacattatgcagttacagtaccttatcagtggagctcgacttctacgctgcaaatggaaatgtattgcaacagtgctaaacagaagttgccctcctctttggagaaaattgcagtatccgagagctctttttaacaagggactacttttaaatgtgtctgatcacctcaaaggataagtagagtgtttcctgccagtagaattagaggaaggaagcaccaggccaaaatgtttgatgtgtgatgtactgtaattcttttcatgtgtttggtggtggcttttatatgatgatcagtgttttgctactatttgtgaccctggtgtggtccaggtcattaaagttcaaccttccttaatgtgtagggtcattaactatacctagcagcattatcataattaaggtactgttttcttttaaacaactatgtctcattttcattaaaatatttcttataattggaaaatcgacctagtgattgtgattctcatgaaagagattattcaacattggagacctgctagtactagcattactgtcgacagatgctctttaggtttcctcactttaccttttagtccttgtttttaaatcagcattttcttcccacaattacctgtgggtatataaagttcaagatggaaactagctttacatggtagttttcctggatgtgagtcttagaggcaataagaattgacaaaattgctgtcagcaatattatatacctttaatgaaacaaaatgtgatgattatacatgttctttgttattctgagatcacatattcagatattcctttaaatgtttaggtttttaaatatttattcagtttaaaatatgtaaaagtaggttctttattctttcatctttatctttctatgccctctaaatttgcttttgggtttttttaaaacttttatatcatttgttcacccattagtcatttagcacttgacaatttgacaatgatagctctaaaggaatatatgctctgttttgggatatgtgtgtttatctgtgtctgagtgtgtgtgtgtttgagggttgtttatttgaagagccagtttcatcttttcccgcatgtgagtatccagatatttttggtatttgccttctgtctctttcaatgctgatactggatatatcattaatacattaatttgaataaagctaaatgcctaaaaggatcttcatgtgataaaataaattgtctttcctccatgcataaagaatcaattttattatcttacttattgatttctttagaataacttgtgaacacctaccattcgctagctatttgctagctgtaaagctgcactggtgacaaaattattcataatctttaccttcatgaaacatagtttaattgactttatcattatacttaaagtatattaattgatttcttgtaaacattttctctaggcaaagaaatacatggcacatttagattataaaggaagaactcacagaattttttatgtcctcagtgtagcaatgtagtgcctgcatttattttattccataagaaagtatttcaccagttttataaattaagctattgtcgtcatagcttactcacttttcaagtcatggcttatgatattaatatttaagatctaaatgatgatgattacattgtaagcataatgaagaacaatgtgaagaaaattttaaaaataactgaggcctttcaccattaatttgtaaataattggcctttaaaaaataggtacaataattttctgcacattcttttgcattatcttgcagcatattaaaatatagatatacaacatgtataattcaaaaacattaatatttaataagaatgatgtatgattataatttttgtattttatattgtattttaatgtaaatgtgatttattaatgtccacaaaatatgaattgcagacagagtatttggagaaggaattattgatacataataaaaattaggccagtgccatggctcatgcctgtaattccagcattttgggaggccaaggtgggagtattgtttgaggccaggggtttgataccaacctggtcagcaaaacaagaccctgtctctacaaaaaattaaaacattagccaggtacacacctgtagttccagctacttgggaggctgaggctggaggatcacttgagcccaggagttcaagattgcaatgagctatgatcatgccactgcactccaatctgggcaacagacctcatttcttgagaaaaagaattaatttgatataatgaatagatgtatttaaataaattggtaatggaaaagatgcctgcaaataagtattgatgctaacttattggaagtatattctgtttctttttttcttttttgtaccataaaacagaaaaggactcatttatttctataagcatttatatatatatatacacacatatttatatttatacattatatttatatatagcatttatatataaaaatgcttatagaaataaatgagttatataaatatataaataaattatatatatatatatatatatatatatatatatatatatatatatatatattttttttttttttttttttttttttttttttttgagacggagtctcactttgtcgcccaggctagagtgcagtggtgcgatctcgactcactgcaaactccgcctcctgggttcacaccattctcctgcctcagcctcccaagtagctgggactacaggcacccgccaccatacctggctaattttttgtatttttagtagagatggggtttcaccatgttagccaggatggtctcgatctcctgacctcatgatccacccgcctcagcctcccaaaagtgctgagattacaggcgtgagctactgcgcccggcctaagcatttctatttttaaggaatactttacagaattaatgaaaaaagagatctaaaattcatcaccagctaaattgggagtcatttttgtagcatctctttcacagctagctgtttgacctcattgttctcagttcataaagtttatattgaatgcttttgcctcagcacatatgctaaggtgtgaagaatatcctttttcacaagactttcatgtctcaattttattcatagaatatttcctagctatttctccacttttgaccatgtcatttttagaactaaatttttgaaactgaagaatttatcagtaaaataatattctatattatctcagtttcttttgtatttcttttgaaagatacaaaaactttcttgtttttgcatttcttttgtaaccaaaatctaaaaactgcataattgttctgtggatttttattgtggtttcgaggccctatttcgaataactgtactttcatgttttaaatgtttgtctttgctattgctcggtgttttcttttctattacagggttattttcttaaagtgtatagagtcatggtatagaagcacaaatactaagattaaatactttttagtcgttattctgcttataaaaactgccaaatgtacattgtgacttttttatatgttgcctcaattctccctatgtgttttctgttttaattatagcttagaaaatctctaggggtaatatatttataccctatatactgtattttagtattacttatctgtttttaagattaccaaagaatattgttttctggtatcaattaaaacttatataagaatttataaacagaatagacaatatagtttaaatattttcatgaaatatttggtattttctgactaaagtcaaccctatgtggctaaagcttttgatatggtactaaatcaacttttttatattcttaagaataagcatggcacatttttttttaactttaagttctggattacacgtgctggacatgcaggtttgttgttacataggtatacatgtgccgtggtggtttgctgcacctatcaacctgtcatctaggttttaagctctgcatgcattaggtgtttgtcctaatgctcttcttccccttccccctgcacccggacaggccccggtgtgtgatgttcccctccctgtgtccatgtgttctcattgttcaactcccactgagtgacaacaaggcatagcacatttattattcccatatttgtataactcttgccatgttaaaacattcatgccgaaagtaaataaatctatctccatactttggtggataagatggggaaaaagatttttacattctaatttttccttaagaaaaaaatgtatctttttattaagaatgccctaatggtgtttcatttcccaagtgaaataggtggtgatctgttctcagctttattaattcctgaatgcatggataaaatattatacttgaagttcttatcagtaataatatataatatgttaaacataattattgctggaaatctgaatagtgtttaatcctagatgtaatggagacctttctagaacctccacttgcaggattaagtttctacagggaaaagttttcaaaagaagcaaattctaatgccaaaccttggaacatagctagcacatttcttcaaagtatgtaccttcattattgtatttttagtagatatggggtttcaccgtgttagccaggatggtctccgtctcctgacctcatgatccgcccgccttggcctcccaaagtgctgggattacagacgtgagccaccgtgcctggcctaagcaataataaaggcttaagcccggcctttattattgacatggacatcatcagaatttcttgtcacatcattgctctttagaataatagagggtcctaataatatctatataatttatcacatcttgattatggttagtggataagggagattttctcagagaggtttcttggtgctatagtagccactgcaaaactcagtggaagagttggaaataggtgagactttgaagaatatgttgagctgtggcaaataggccaggtagaggaaaagaaggtggtcagaaaatagaggcagaaataaagcatggtacacttagagacatgaggatgcttgttttttgtatcagagtacttgttattggggcataatgagagagatgtggggacaagtgattgagatcagactgtggcagctttgaattcctggttaaggaatttgtgctttattacataggtggatggagagcccttaagtatttttgatcaggtttgaaccattttgggagaattaattacagtgccaagtacatagtaagtgtttaaagagcacagcctttccaagtgacctcagccaacatacagcacttaactccctcaattttatttgtaaaacagggatgataatactacctacctcatagggttgttatgaggattacataaattaatgcatataaaacatttaaaacttgtctggtactttgtaagtattcagtgccatcccaatcaagctaccaatgactttcttcacagaattggaaaaaactactttaaatttcatttggaaccaaaaaagagcccgcattgccaagtcaatcctgagccaaaagaacaaagctggaggcatcacactacctgacttcaaactatactacaaggctacagtaaccaaagcagcatggtactggtaccaaaacagagatatagatcaatggaacaaaacagggccctcagaaataacgccgcagatctacaactatctgatctttgacaaacctgagaaaaacaagcaatggggaaaggattccctatttaataaatggtgctgggaaaactggctagccatatgtagaaagctgaaactcaatcccttccttacaccttatacaaaaatcaattcaagatggattaaagacttaaacgttacacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacaaaatgggagaaaatttttgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacactagttagaatggcaatcataaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgctagactggattaagaaaatgtggcacatatacaccatggaatactatgcagccataaaaaatgatgagttcacgtcctttgtagggacatggatgaagctggaaaccatcattctcagtagactatcgcaagaacaaaaaaccaaacaccgcatgttctcactcataggtgggaactgaacaatgagaacacttggacacagggtggggaacatcacacagcagggcctgttgtggggtgggggtcagggggagggatagcattgggagatatacctaatgctagatgatgagttagtgggtgcagcgcaccagcatggcacatgtatacatatgtaactaacctgcacaatgtgcacatgtaccctaaaacttaaggtataataataataaaaaaaattcagaagtatttactgaattttataattcagccgtaattattatacttattgaatgtttttgaaatgattgcttagtgcttagtctgactatagtatttaatatattgattgaattgtggaaagaattctacctaccgctttttgcttatgcaaaattaaataagtaaaataccactgatgaaatgagaaattgtaattttgtatgtgctgcaaaacaacaacaacaacaataaacctttacaagcatccttatcccagctacacaagaggtttatatcaacttaaaatccccagataattttcaacttgtttcaagccctgcctaataataggccatattagtagctagcatttagatagcattttacaggttacagagtacttttttatatattccctcctttagatttcaccaaatccttaggcactactcagtgctgtaattcattttacagtggagaaaacgaagctcagggatgcctaagatcacacagctagtttgtgctctgaaccactacaccataattctgtttggcctttttattgaaacaactatatcaaaacaatatagagtacaagaaaatgctttttctatgcccaccaccttcctctgttctgtaccttgctttttaaactctgccatgtaagactcatcacttggacaaacataatttcattcatagatttttactgtgatattctattgcatgaatatgccaagttattatgtcattccttctgttggtggagatttacgtttttaatttttctgtatcacttgtagtgttaaaatgaatattcttcaacattctccttgtacgcacatgtaatagtttttctagggcagtgccttctagtagaatgtcctgtgatagtggaaatttctgtatctgcactaatacagtagccattatctactgtaactactgtaactaatacagtagccgttagccatgtaactactacactatgactcaaggaattaaggagctaaattttttaaattgtatttaattttaattaattttaaagagacatatacagctggtagctattgggcagcataactctgggttatgtatctaggagtttaattgctaggtgataggttacatagcctcaatgctgatagatttcacgaaattgtgtcagatttatattctcaattgctgagtataagagtttcgtggctctctggcaaacagccttaatactgttgcattaggcactatacacttaggattatcttagtactagatatttgtggatgatgtttaaggaaagatattttctctctacaactggaggtgataaactaatggatggtacctagtatgattagatatgctttctaatgtatggcaattgaagggcattgtgctactgtcaggaaaatatattaaattttctaatcaaatgttagactatgtagcccttgttgctaactagaagatcatgattgatacttttccttaaagaaactatctttattctgattaatttgcaaattaagttattcatattttaacatcatacattaagagattttatggactgttgctgtatttttaaaaattcatacctttctttacaaatagagaattgcttaatgattattgtaagtttgagaatactaacttctgttcctattctttcttcttgaccgattttataatatttgtgagtcggaagtaactccatacattaaaaaccatgttaaataatgtgacaacatttttttaaagggagttgatttgttatataccacatctaaaggttttttttttcctcctcaaatttcctgttttaaatcaattctaatctgttgccttggaattagtctttatcatgtttaatttgaagtcttacagtttttcatccaacaacatacaaatacatttaaataaagcatagttttacattttattttgaaggctagttctcatattgttaggtacagaacgtaggcgacaagaggggactgaatttatagtcagaaggtgtggtttcccatttggactatgctgtttctcatcctccttacctaaatcatcagcatctgtaaaatgaagtctacctatagcaccctgtgagttgtgatttatctacataatattgaaacccctttgcaaaccattaaactgtaatcaaatgtaaagtggcattattaatattattactatcatttatgtatttctgtattttgtattacaaagctcttcataatttggtagtagaattggaatgactggaaatgaaagaatgtaattaaagagaaaaaaatttaagtgatataattagagacatagtaataaaaatgaatttggttaagagataaagggagatatctttgttagaattgttattaaaggtttcccaaacagtttggaattagtacttgtttacgtacagtttaatttagccacaatttacttttcataaatatttttctatgattttttcttattatggaaattatttagaaaattaagtagaacttgacttttaaaaagtaatgtactatgaacatttggggaccttatctgtgctcaccttggttcagatagcagagatacattgttcaaagttagagagctgtaatgacccaagtatcagaatgtggttttgagaatcaatagggatgctagtttagataaaaaagggaaaagagggcatgttcctcagcctagtccagaccttctgaatcataatgtctaaagatgggagctgaatattttgaacaaactccctgggtgattcttctgcactctgaagattagtactcctgccctaatcgttggtgatggaactcagcatttgtttcagtctgacagacaattattatatcccctgtcctatttactctcaaaattactgtcacttatggagacttggtgataaatatgtagacatttaatttaatcaaggcataaaagttttacttctttttcattcctattttctgccttatttaacattttgtggatctcaattgagctataagtgaatgaatttcacttctttacagtgaattcccgagatatgcctattcagcagtgagtagtaaatggttcaacatgagctgttccttatgtaaacatacaaaaggcctgacccagactaaatcaatttaaaaaggaaaacattaaagctatgtttcctgttatatacttaaagtcttctttggttccttatgattacattatcgaccaactattgcagactttatcctcctacaccacctgctgaatggttcaaatggtatgggataagagtttcggaagggcaaagcaattacaattataactcctacattgtagccaataaagcagctttttgtgctaaggataaggaagtcatgggcttcttgattcaccccctttcctgatttgaattgctacaaggttttaaaggctgcaataaggagacagcaaagttcatagagcttttagaagtatgtgaagttgagaccagaaaatttaagtcctgtttatgatagcaaacatttctaggaaacatttaattagtaaatgaaacaacaatataacgcttttttattataagatgtttacattgtattttttaaggcagacgttaacattaggcattctggtcctcaccataggaccagctatagtcctttacctatgattagctgcttagtaaagtatcattctattagaattctttgctctaattattctgcaattgttgtttgtgctaggaaaacttggtgtactaaatcaaagttctcttgaataaaatatactttcatttttggcattgtaatcagaatgtttttcactcctacaagtcttatttttaagttataaagttcttttcttagggaagggagctgtaaaattgtaaaatgattttcagtctttgaaaaaataaattatttgtgaatcttgtgtctgtaactatttaccaaaaactttaaaaaaactctagtgagccatgagatgtgaaatatctttcagaagacatcttgccttaatattgcttaatgaaagttaatgtaccccataaatttatacattatgatttttcattaaaaataaaaattttgaaaagctagcatatggtatttgaaaacattttgaatatgttttcttaatttcatattgaaaaagcaaaaatgcttttaatatttcataataaccgaaattggttttaagtatgtataggacaaaacaggagtatatcttacacattaaaaaatagagattagtgactatttcaagttgagggaaaaaatcctcctattttttggaaaatgaagtaaatcagtgcattactactgtattttcttataacgataaagaaaaataaatcttggggattatgtaataagaaagaaaaattaaatttttatctgcctaaaaaaactatcctgtatttgttttattagagaaaaattaaaccaaacttgtaaattttatacatattagctaattcttcaaaatataatattttattaactcaaaccaataagctaaatggtctacctttataatttgtaatagaaattttcatttgtacttggaaaactatctacagaggagatacattgatgtttcctggttttgatagctcaggagactaagattgttgaagaaactgtgttttaaagatgcaagaatatttttatttcgcctaaattttccacaataaagtttttcttggcttagaaagtaagaggtctattgcatactaaccagcatactgttaaaacactgttaagttgatgaaacagatcaaattagaaaatgtgggtagaattcattgagtttgatttattaaattgagtatcactggtgttctctgctcagctgttgtttctttttagaatcctagtacgtgctttatccagctaagtctgtcttattctcactttccagtcattttacttctatttgacattttatacagagtctgaggaaagatttcaaagtagggttttttttcctgacaatttttgaagtttttatgatgtgatgacttctgtgccaggctctctctatattatctcacttaattttcataattaagacagaaacccaggtttttctctcctcttggctattgtgctactacagaatttatgcaacctatttggcacgggataaaatgccagtttgcaaggcaagcccatcttgtgggctgcacctcttcctcaaacactgggcctcatacaagtctctgatagttggtacaaaacggcctgtctttggctggaaacctccatgccttataccattgctttctcccctgcctctctccaggcccgctgttcagagccttttcagggtttctagatgtgctactgcctcacacctttcagcctttgaacctgctacttcctctgctggagattctttcttgtatgaaatgagataactgggcttttttgaacttgtttctatgttgccttcctctttcctgggcctcccaagtctgggtcaggtgtcccttctatgtgcttccaattttattttatacataaccttttggagtattaagtgttgtataattgcctctaaatcccacattagactgtaagtgttatgagggcagggaccatccagggacctattattcttagggcctatcacaatacctgacatacagtgcccaataaataatgcaagtcaggtcactggaggaagggctgttttgataggagaatataattttgaagtcctgactaaggctatgagtagggaagaaactggttgctttataccacttactactttactagcagttttattttataacaatatggttttaaaatagagtcattttcatgtagaaaaagagttatagaagaagtaatgttatatttggtaggagaaattagaggacgctatattaatagaaatatcttctagggacagtgacgactaggagagattttttttttttttcacagtaagccgtaaaatctttgttgctataaatcttcctattcatttaactatttaatcttcacaacatcctagttatgtttccttttttcttgcgaatagtatattttgccttctatctttatctttttttccctttaatgctagaaatttgtctatttttggctttgttgatcttttttattgtgctctatatccttccctctttcttttagtttattctactttttatgttcagcttattgagacttttttatttgctaaaactagtattttagacaataaattatcctgtgccacttgaactgcatcctacaatgtttaatgcataacatttgcttttaagtattaacttttattatgatttttttgaccagtggatgactcatttagaagtgtgttttaaaatttctaaacataagcagttttgtgaattctcttctttaataaaatatctaactgaattgtattgtgctcagaggatacagtctatatgatactaattcactgaaatgtactgaggctagctttatggcctagcaggttgtcggattttataaatgttcctgtgtgcttgagaaaaatatgtattctccagttgtcagatactgtgttctgtaaatgttcacctcatcacacatattatgtttttcaatttttctgtatttttcttcttacctgcttagagggttaaagttttccaccatggaggacagatttgtcagtttctccttgtagagctatcagtttttcttttatatgttttgaggctgtttttacaaataaatttagaattgtcttaacctccaaatgtactgaatcttttgtcttcaggcagtaactatttttaaatagagttaaagtctatgttgtataatgtaatgtaaatttaattacttaagttttttgtcaaatgtttgcttagtatatatttttgcatatgttgactctttctgtgccctaaagttttaggtgtgcctcataaaaaacagaatattgattgatttattaaatgcaatctgacagttcttatcttttaatgggagagtttaaattatttatatttatgctgcttattatgtttggatttttatttgtatcttcttcttaggtgctttctacttgcccaactttggtttttcatttctgacattctaatttttatttatttggaagttatgtgttccatatctgttattttagtggctactctggctatgttaacatgtgtacttaacagaagtctgaagttaatatctttttcttcttcttcaacaatacaagaaacttagaacattttatctcaaattatctggtccccttatttatatattattatccagtgtcttatttttggcctgttttctcatcacaatttagacatcattattattaatttaaacataatatatgtttagacttagtcatatatttaccaatgtcttccttatgattatttcttgggatactttgggctgcctggatttagggcttggcatttttcaataattgtggaataattataagacattatctcttcaaatattgcctcctccttgttctgtctattacctccctcaagctttaattaagcattttttagactttctctctctattctccatgaatcttaaccttctttcatttatagtatttccttgtctctttggattaaattctggatttcattggacctttcttttaattcactatcactttagctgggcttaatctgcttgagttttattttttttctcatttgtagttctacatggttctttttaaagtcttgttccctgctcatactttgaagatgcttttttactttttaaataattattttatattttatgtttgctagtctgtccattgttactgctgttgtgtgaattgtgaattttgtctgtgagtgtctcatttcacttggaacctgatctgtggaagttctttgagttgaaattgatttcatcccaagagactgtgcttttacttttgcctttacatgtcatctggcagcactgtctacctggagcaagactgtccagactgaatttttgttcataccatatgtgagactcaaacttccaagtcctggctcatgactgcaaaatcttggaacattgctttttagtttgggttttgtgggttggttggtttttattttgtttttttttttttcccctttacccattagtaaggtaaagacaggtaagttgataaattaccttgtccatttctacatgagcataaggagaactgttgctttaaaaaatatattttgaaatatagattcataaagaattacaaaaaatatttggagaagtcctgtgtgcactttacccagtttccctcaatggaaacgtcttgtataactatagtacaatatcaagaccaggaagttgacattagtacaatcaatacacagttgtattcagattctgccaattttacatgcacttagttgtgttaatgtatatagtgctctatgtaattttgtcacatgtagattcatgtaaccaccatcacaatcaagatacagaactgtcctatcaccacagaggtccgtagaagggctgtttctaattcaccctttcactactggtgacccttcgtgatctcagctttatgtgaattgtcttctattaaatagattcatcatttgcgtgagccctgagcttcatctcctcctgtgcagttaacagagcagaaaatcagtatctgcaggatttagcagaaaaccttagagtaaaagccagctttggcaggtgcttatttatcatggttcctggtttcacattatttgggagacttcccagcttctgttattctgttattggtgttggctccaggatgtgtctgaaaaaatactttagatttgttaaagcaatttgttatgagagccaggaggttcattcagagtttctaatatgccatattcagaaataggtgatactagaaatgttaaggaacatttatctttatcgttttcgttgcagttcattcataaagtggattttgttttatcttgatacttgtgcatctgtgattagttggtgatttaaatatgctgttcattcagaatcatataagataatatacttccataatagtcataaaatctacaaggtactttatgaatagtttttcaattacacatatattttatttatctttataatagtcatatcaaaatagctaaagcacagagaagttaaataatttctgcaagctcatgatcattggaaagtctgagactaaaactcacataaatcagctgcttatcctactttccccaactgagatttggaaggttttgcaattaacttttaagttggatttatatactcaaatattataaattactctgaattttttcaaatcaagtatgtcacatatatgtcaatatatcaaatatatagtttaattttaaaagcaagcaataagaaaaaatatagaaatactaatcctaatccctaaaagtttgaaatttgaaaattaccatttttggaagtatctggctatcactcaaaatggaaagtatttttgcatagggaagaagaacctgtgggaaataattgataaatgatggcaggagaaacatagcttaatttaagtccaaaaaaaaaatgggaaatttcaagcctaaaagcaatgtaaaagtctgatgaaacttggtgtttttgtgattgtaatcttgttaattatacagcttttccatgtatcaagggaaataggaaatcggttgtttacattgggattaggttgatttgtcttttaatatagcactaattttgttttcattttttttccttcaaaggtattcttaaagtattttagttcaccttaaaaatatgtttagggagtttatttaaaatgtagagagcattggctgttttaaaataggtaaaagtaatgtttatatggtgagtaataatctagggaaataggttaggccatcaactgcctcagatatttgctggctatcagaatttatgtggccctgattcaaaagtttagtcttttaaagactatgtgctcttattgctgtgtacagataggttctccgcctgagatttgtaaagatttatgtcagtacaaatcagtgaattgaaacagcatttacctgttgctagatagtatagatagttcctgacctcaagaatgtgtggtatatttgggaagactgataagtcaatgtggtattattatatttacaagcatagagagaccctaagaacagagatttgggaaaggggagtttggaggaagggtgatcaggaaaagcttcataaaaacagagttagctgagctgggcctttaagaattaacaaaattacaccaatatttaaatgaaactagaacattcttctacagagagactctcaaaatgcctctccttcatacccccactgtcattcattccttttctctttaccttaaggcaaattgaaaggattaatggcccacttatgagccctatttctcatgcagttcttgagtttgtataaaattttagttcacctttcctgtaatttttctaagttagaaaggagaaaacacagatccagctcctaccttaggaatcatgagaattatcctcagtttctctggctcctgctttggcttgttgaccagtggctgtttgttccccttttcccgtgttcataactctttctgacatctcactagctgagccacttgcttattccactcaggtctgctccttgcttctctcttcacttgaattaattaatgtcagccctcaccttgcctggcccagtcctgagcagctggcccagacacccgttgtcttgagtctgagcagtcattcactgtccattatcatttaaccagcctctgggagtgcttgttctgacctccacaccttcttagtcaaccaaggcataaactgaatcagattttgcctttttctatacttttcacactaggacccccatcacctcccaataataagtttcgttagtgttcaactgatgtaattaacttaattgtatttttttctaatgtctgtaattgaagcttttaaaaatatttctactagtaaggctatttttattctctttgttatttcaacttttcttctgataaaaacttttatgggggccaaaagctattttttcttttgatcatctactttaaaacttttctgaaccaacaaaacttaacataagaaaaaagccccaaattcaggcagacttaagttttctctggctctcaaactttgtgcttcccaccctaccttattgccttgctattttactctaaaaccttcatgaaaatttttatgtatttacttcctttaatttaactttacagattattttattcatttacttagcagtggacccaataggatcaacgttgtatgttccaactctatatagggcagtaaacctctctgttattctacatcagaaaccttgtcatttctcaacaactacatttgggttatataaagaatgaagagcaagggttgaaggggtgaaatagattaagaaggctccattacctttcctaacaagaaatcaaagctcagaagaaagtagacgattagcaagggaaagggttttgagtaaaaaacaaaaaacaaacaaacaaaaaaccctgtatttgtgttgtagttttgtcccatactagttttgtaactttagctgtctttcaaactctgtgaattattttctcattggtaaaaatggacataaaatagaacctcagagcatctcagggattgaaatcatgtatgtgagagtacttagaaaaagagtaacgtgccaggaataacataataaatcattatagtgtagattactgtaagtgataagttttggatatgttttcaagtcataatatgtactaactttctgaaacctttttcatagatgtgccccagtttattcatcagtaatccaaaggaaaaaaatggtattgacactatgttagtgaacaaaataaacatagaatggttattttatctgttttcttgtttttatttttgtttttttcgctgcctttacaggagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcaggtaggaaatgattgagaaactttctactctttctaatacttcattgccagaatagttggtgatacaatctttagcatgtccaaccaacctaagtattttggtattgcttctgcttttcattataagcataaaaaatattttgtaattgtagctgatgatttggcatggaaacctgctagtcctaccagtgttacactgaaattattacaaatttaggattatgttagcatagaaaaaaaaagcttactatttattgaaagaatctacttcaggctaaaggatacacattttctcttaaaatctattgtatttggggtcaattgtttgatgtttagactctcctttttgcttataataacaagaaaagttaatgaatactctgcaaagttatgtttaagttagagtgtggggaaaaacaagagtttctggctctagggttttttccatccactttaactaaaagcaactatgttgatagatctttttaaattttttttatttcaatagttttttgggtacaggtagttttgggttacatgtataagttatttaggggtgatttctgggatcttggtacacccatcacctgagtagtatacactgagtccaatatgtagtcttttatccctcactccccttcctcaccacccccacccctgagtccccaaagtccattatatcattcttatgactttgcattctcatagcttacctcccacttataagtgagaatatatgatacttggttttccattcctgagttacttcccttagaataatggccaccagttccatctaagttgctgcaaaagacattgtttcattcttttttatggctgagtagtagaccatggtgtatatataccacattttctttatccactcattggttgacgggcacttcgattgtttacacctctttacaattgcgaattgtgctgctattaacatgtgtgtgcatgtgtctttttcatataatgacttattttcctttgaaaagatacctagtggtgagactgctggattgaatggtagttctacttttagttctttaagaaatctcgtagagaacatttttaaaggaagtagtcctgaatgtgtactcttaacgatttatagtcactgccacctttcccaggctacttgtggttctcatcggagaaataggtagaatcatttgctagaaaggcggtattaggcattaaagctacatacctttatattgtaaaactagaggtctttatgattttaagaaagtattaattatttttcttctgcttttctctttataaaatagaatcagtaatacctgttgcttgtaacataccgtggtggtttattgattgaatttcttgaaaacatcttctgaagacttcattgtatgccttttgcaattctgattgcttaggttctgcccttttctaccaaaactacatttgtccatgtcttggcaataataatagcagcaacattaataatggattatgcaacgcttatcactttacccagtttatttaacttaattttcacaataatcctaccaggtaataactgttattttccctaattatacatgaagaaactaaggcctacaaaagataaataatgtatcaaaaaccaaacagtaaaatatagtttgtactccttaggtctttatatgtgatcttctctgtacctgtaactgtcataacccaccctcttcacttgcctagctcctatcatttagcaagcctcagagtagacatcatgttttctttttattattattattatgcttttaagttctagggtacatgtgcacaacgtgcaggtttcttacatatgaatacatgtgccatgttggtgtgctgcacccattaactcatcatttacgttaggtatttctcctaatgctatctctcccccctacccccaccccacaacaggccccagtatgtgatgctccccaccctgtgtccaagtgttctcattgttcaattcccacctatgagtgagaacatgcggtgtttggttttctgtccttgcaatagtttgctcacaatgatggtttccagcttcatccatgtccctacaaaggacgtgaactcatccttttttatggctgcatagtattccgtggggtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctggatcaaatggtatttctagttctagatccttgaggaattgccacactgtcttccacaatggttgaactaatttacagtcccaccaacagtgtaaaagtgttcctatttctccacatcctctccagcacctgttgtttcctgactttttaatgattgccattctaactggtgtgagatggtatcttattttggttttgatttgcatttctctgatggccagtgatgagcatttttcatgtgtctgttggctgcataaatgtcttcttttgaaaagtgtctgttcatatccttcacccactttttgatggggttatttgattttttgttgtaaatttgtttaagttctttgtagattctggatattagccctttgtcagatagatagattgcaaaaatgttctcccattctgtaggttgcctcttcactctgatggtagtttcttttgctgtgcagaagctctttagtttaattagatcccatttgtctattttcgcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattatataggaaatcctttccccattgcttgtttttgtcaggtttgtcaaagatcagatggttgtagatacgcggcattatttctgagggctctattctgttccattgttctatatctctgttttggtaccagtaccatgctgttttggttactgtagccgtgtagtatagtttgaagtcaggtagcgtgatgcctccagctttgttctttttgcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctatctgtgagcatggaatattcttccatttctttgtgtcctcttttctttcattgagcagtcgtctgtagttctccttaaagaggtccttcccatcccttgtaagttggattcctaggtattttattctctttgaagcaattgtgaatgggagttcactcatgatttggctctctgtttgtctgttattggtgaataggaatgcttgtgatttttacacattgattttgtatcctgagattttactgaagttgcttatcagcttaaggagattttgggctgagacgatgggattttctaaatataaaatcatggtagacgtgttttctaggaagccttccctgagcctgtcagaagaccaagttaagtctcatttgtgtgtgctcctatcacatcacttaacatattttattctaattacttatataactacctctgggtcctgaggacagagatcatcgccatcatgttcattgatttatccctagaacatagcactgccgtatataaaatgtattattgtagtccttcactgacaagtgattgaatgtgcccctgagaaggggtgtaaatttggatgaagaagcacatacagccagccagggtaaatttcagagaggaatgcaataatggagtcatcagcatgcaacttgcatggcagctgggaagtgaatattttcatcataaaggagaatcttggtggcacaccacagcatcaactacactaatcataacctctaaatatcacatgatagcatccagcttcaagccttcctattccttatctttacacagttttcagatttaggaggtgccagcttataaaagtcacaggttattgtgtcttaaaaatcacaaattctatcataacaaagaacatgagccttatttttctaggaaattttatggccacctagccttagttgtatctctcctatttgttctttaattcatttaacttatggtttgtgtatgtgtgtatgtgttttaataatttatggagataaattcacataacataaaattaaccatttaaggtgaacatttagtggcatttagtacatttacaatattgagcaactaccacctctgtctagttccaaaacattttcttcaccccaaagtaaaatccgttgcctggtaggcagtttgtctctatctttctccctctttccagttcctagcaaccaccaatctgcctctaaattcaccaatctggatttatcatgtctgtatgaatttatgtattctggagattttatataaatagaatcatatgatatgtgaccttttatatctggcctctttcacttagcatactgttttgtatattcatccaaattgtagcatatatcagtatttcaatctttttatagccgaataatattccactgtgtgtatgtaagtgatctatgatttataatgggtcaatttaagatttttcaactttatgatgatgcaaaaataataatgcattcagtagaaactgtactttgcatacctgtacagccattccggttttcactttcagtacagtattcaataactacatgagatattcagtgttttggtataagctaggctttctgttagatgattttgcccaaccaaggccaatgtaagtgttctgaacacatttaagataggctaggttaagctatgatgtttgattggttaagtgtattaaatacattcttgacttatgatgcattcaacttacaatgagtttgtcaggatggaaccccattatgagttgaggatcatctgtacactacaatttgtctatccatttatccactgatggacatttgagctgtttctgctttttggctactgtgaataatgttgctatggatattgctgtacaagtacctgttttcacatatttgggtatacacctagaagtagaattacagggtcatatggcaattttatgttcagctttttgagaaactgccaaactcttttcaaccataaaatggctgaaccattttgtattcccaccagcaatgtttgagggttcgtttctccacattcttactaatactcacttttctttctttcttttgttttgtttgtttgttttttggtaagctaacacatcatcctactgggtgtgaggtggtacatcattgtggttttcacttacatctctataatgattaatgaacttgagcagctttttgtgtgcttgttggctgtttgtgtattttctttggagaaaagcttatttgtcttttgccccccccatccccaccccacgcttttttgagacagagtcttgctttgtcacccaggttggagtgcagtggtatgatctcagcccactgtaacctctgcctcctgggttcaacccattttcctgcctcatcctcccaagtacctgggatgacaggcatctgccactgtgccctgccaatttttgtatttttagtagagatggagtttccccaggttggccaggctggcctcgaacttctaacctcaagcgatccaccagccttagcctcccaaagttctgggattaccagtgtgagccaccgcacctggccttttggctgttttttaattgagttgcttgacttcttgttgatgagttgtaagagttctttatttattctagatgctatatccttatcagatatatgatttagaaatttttttataatggaatttttttgtttatggtatgaggtaaaggtccaatttcattttttaacatatgggtttccggttgtgctgtcatcatttactaaagatactagtctttccccattgaatgatcctgtcaccctcatcaaaaattgacagagacttttgatggctgtgtgtggtcaaaaattaacagaattttgatggctcatgcttgtaatcctaacattttgagaggccaaagcgggaggatcgcttgaagccaggagtttaagatcagcctaggcaacatagtgagaccttgtctcaacaacaacaacacaatttttttaattagcagggcatggtggcatgcacctatggtcctagcttctcttgaggctgaagcaggaggatcagttaagcccaggagttcaaggctgcattgcgctatgatcatgtcacttcacctccatcctcgtcaacagagcaaaaccctgtctcaaataaataaatgagtaataaaaaacacagacttttgaatgtctagtgtatgccatcaaaggtcttttacactggagaaacaaaatgaaataatttctaatattattctagtatatgtcctgtaagaagttcagcatccaatcaaagaaacagacttgctatttaactattagaatgcagtgtgaagaatgctatgatagacaaatacagcatagttaggcttacagaagaaacacatccaaatcaagataaatatattccatatacataggagatcttaggcacaggcacataagcaaaaagataaattaatgcaaagttcacataggtacaaaatagtcaatcattcatttctctttttaaaagaaaaaaaagagaaatgaatgattgagtctatcggtggggtttcagagaaggtttcacagagtgcatggcttctgaacttgtttccacagagtatgggtgcctgcagagtagagggagcattccgaagaaggaagcagtagatccagaggctagaagtatgaaagtgtggcatgttttatctggcacataatgtcatgcttggcacataacagataccaaataaaggctaacttaattaatgacagagtgatgattaagtagggccaactaatcaagagactgaatgtgaatgtttatgaaagatattcattcaaataaaaacagaaaattttagatctgttgtagcttagttctgatgattaatcttgacagacgtataaataggactttaatataattctgtttctgaataggtaatatagatgaaattcaaaagatataatgaagagtaatgtgtttacttccctgaccaatattaaatggcaacctttataatgattttcattcattcctctgggtacattactcaaattttgtctttaattgtgatgtgcttctatgtgtatgttgtagggagtggggagtagggaagttaagtgtagagaatcatcagattttaaaacttgaagatcttctgttcctaaaaccttaatttttttttattccaaaggaatatatcatggtttaattaaggcagcagaaccaatagagtattacagagtaagagattcattttaggcataaaatcttacccagttgtagaaaaagctgagaagtaaaggtccagaagagggagttgaaggatcaaagtcacaaccaaccctcctgaagcacttgacctggttaaaaactttggagctttcaagaacctgggaaacatccggcagcacatccaactggtggactgaaaccaccagagagctgatagacattaatgggaggctgtggcctctgcatctggggtaaggccgggaggctggagttgctgttgttcagcagggtcaagagtcaggaagaagaagtgatcacagagacaggaaaagtgagaacaagccagaatctgccagcacctttccattggtctttcactgcatttaaaacatgaagacttgcaaagaatattggctattatttccctccatcttccaaatgttgttaaggttcctcttttgcaaaactctaaactctgaattattcttaggaagttgttataaaacaaaaactacagtaaactaaatttgaagtggttctttggcttgtccagtgtcacaaaaaatagagctatgtgtagaaccttggtttccttcctcttactagtcaactacttttcttctgctcaaggctcagacctcgtaggcttgtgctaaagtccattgttagctaatcactttctttttctttttctcttagcaacatttttgctacatctgggtttattttataatctgaggaaatgtactgatgtctgccatgtgcagtttgcacattcaagtgacttgctgctttatatggatactagtgctttagggggaggtggaaagtttatcttatgattacctgaaagtaccactaagtcttaattctccaagttaatattgatataattttctcatgtataatatttaaagatataattctaatagactttgcaaaagtacacttaaaagtaaataattttgttttgatcataatacttttatttcttcctatctctgacttgattttgttaggtaatttatcttttaaacttcattgtcagagaaatagttacagcatatttgtttgttaaaatatttttatatacacataataaattacatgtaatactctgtgggcttttttttttttacacataaagaattttaaaaattgttgttactatgtttgcttagcaagctgactttgaatctgacatgacatattcctaaagttcatcagtcttatacttctcaggattggtaacattgaatatggggaactatggctatgtgtaggcattaaaattcctaaaccatatatttctagctttatttctgagagattacgactattctctgtgtccttagatctcttttatttttatttttgagactattccccaaatgttcacaccgcacaggacccccagcatagtttgattagtgattaatcaaacatgagattttttccagaattgcatctggaattgtagataggaatatggaaagaaagaagttttctttgttttaaattttcaacctgaaaaacatcacttttatcttactaatttgtgaggacgtcaagctaagacctaagcaaaatttgggcacagtggctcatgctgggcacagtggtctctcactactttgggaggccaaatctaattctcatactttgtaggttaatgcctagattgacctaaacctacttgaatgatatgattttataatttccttaaaccttaccatgcctttacatgaaaaatgtgaatttttcttcctgcctaaaaagttcctggaaagtgagtgggaaggcaaaaggattcatgttacaacaggaggcagcagttggtttttcatgcttagcagccagcagatatcttcttccttacatgttggctgagagtgtcctgtggcaatataaaaagatggtgtagatataacagggcagagatcctgtcttgcctggtcttactcttctttatatcttagtgtagttactgactgatatagtaggcactaaaaaataagaaaatgtttaaattgtatataattatcatggtagcatacgataaaattttaaaatcttctgtattttcaattactttacagtcatcttacagctaagatggatggatagataatgccttgattcattgaaacccaactgaccaaagccctaaatagccagtttccctcctatggtgttttcttcttctttttttttttttgagatggagtctcactctgtcactcaggctggagtgtagtggtgcagtctcagctcactgcagtctccgcctcctgggttcaagcaattctcctgcctctcagcctcctgagtagctggaattacaggcatgtgccgccacgcccagctgatttttgtatttttagtagagacggggttccaccatgttggccaggctggtcttgaactcctgacctcaggtgatccaccagccttggcctcccaaagtagtgagaggccactgtgcccagcgtgagccactgtgcccagccatggtgttttctttttaagagaaggggccaaacaggattatatcaagaatgtattttaaaagcatttgtacaacatgtaacttttatacattatcctgtataattctgtgagcactataactggtacaacagtacatactattgaagtttactggtttatttatgaatgacagggtctcactgtgtcacttatagttcactgtgttgtgatcatagttcactgtaacctccaactcctgggctctaacgatcctcctgcctcatcctcccaaagcactggattataggtgtgagccactgtacccagccatattattgaagctttaaaaatgaaatttaaaaaatctcctgaccttctctcccttagtatattcctatctaaatcctcaacacagtttctaatgttctcttctctgagaaacattcagcaatacccctagtcgctccctcttccatgaagtttttttttaagcttttcctttgaaaagttctaacaagtaaaattagatgaccagcagttccaggttatagatataaacaactggaatcagagctattatccattggacatctcagtaaaattgaattaagttaatattttaatttagtatgctcataaaactgtcttctagatattgtaataaatagacgtagcacttgtgatctccattacaaatatattaacctttgttttgttcttttgttttggcaggaaagtttttgttggtgttttttttttttcaagaatgagaatattttattttaacattatttaattttgccgaactaaatttatactgatactttctttaaatgtaccttaaaaatcatcatttcaagctgtagttcttgtagcattgtgcacaagatgctttatatgtctttatagattctttgtgtatgttcagcaccttgagataaaagattaggtcccctattgagtatttccacacctctctgtactttccttattattatacttatcataccttatgattactttgtttagttatctttcctgctaaactgaattccgtgagaaacaacattatgtatccatttttgccattgttgtttcagcacctagcaaaggacctggcaccatagggagccctcaatccatgtttctcaatttcagagtaataaatgctatgaaaataatataactgggtaatataataagagtaattgggaaatttccttagattggagctcagggaaggccccttctaatacctgaatgacaaaaatgagctatctgttcaaatacacctggagtgtttctgctgagagtgttttaggaagagcaaagacactcgagtaggaacaagttgagcacgtttaagggttcatgcctggctgggaggaaagaagtaatagcagaggagttttagggagaaaagggctaaataatgaacggttttgtaagtcagagagagtttgaattttattttaattgcatttgaaagtcattggatagtgctcttgttgaaaaaaaagcctctaaatggatatataccgataactattattattattattattattatttttttttgagacggagtcttgctctgtcacccaggctggagtgcagtggtgcaatctcgtctcactgcagcctctgcctcccgggttcaagcgattctcttgcctcagcctccgaagtagctgggactacaggcccacgccaccacgcctggctaacttttgtattttttgtagagatggggttttaccatgttggccagactgatcttgaactccaggcctcaggcaatccacccacctcggcctcccaaagtgctagtattacaggtatgagtcaccatgcctggccaactatttcattttttaagttcctataggatttaaattatttatctttatgcctcccattaatataaacagaagaatatctaggaataggtttatgtaacacatagttttccaggtagcagattgtttataataaatgtttgggaatgttactgttttcatatttaggaataactactgtaagagatggtctcaggtgataaccacaagtttttttttgtttttttgttttttttttttgagatggagtcttgctctatcgcccaggctggagtgcagtggcgcaattttggctcactgcaagctctgtctcccgggttcacgccattctcctgcctcagcctcccgagtagctggggctacaggcgcccgccaccacgcccggctaattttttttgttgttgttgtatttttagtagagacggggtctcaccatgttagccaggatggtctcgatctcctgacctcgtgatccgcctgcctcggcctcccaaagtgctgggattacaggtgtgagccaccacgcctggccgattaccacaagttttaagtatcttctgctctagcatcttccatctaaagttcagccataatgacatactaagaaaatctttatgttgcataagaattgctctgtgcaccagcctgggcagcatggcgaaaccccgtctctacaaaaaatacaaaaattagccgggtgtgcagtccacacacttatagccctaactacttaggaggctgaggtactgggatgacttgagcccaggaggcagaggttgcagtgagccaagatcatgccactccactctagcctgggtgacaaagacagagggagaccctttctcatacacaaaagggaaaaaaaaaaaaagaaaaaagaattgctctgtgcacacagaccatctagcatttcttattctgacttttttggtggaatattttgggaaccttggtaccacttttcctacttctggtctttcataatatgcagtttttgaagtgtgattcttaaactcctttagtatttcccacaaaggcataccaaaatgtatgacagatgggcagaagaaccttagtgtaaatattctgagtccaagaaagatgaccacagcctttctgacacatgtgttttcttgagtgcatgtggcatacacctgtgccttcttgcttagtaacaatttcagagaactatactttttttttgtttacaatctatacctcccaaagcttactagaacagcttttgccaactcacatgattatttttctgttatttgcttagaaccttaaaatagtcaatgttttgttattttcatcgagggtttaataaatttctatggacataatcctctatattactacatgataggtacagataattataccatttctttgtttatgtggacaatatagacatacattaaaccattgttttattggagtacatcagcgaattattgattctacagctcctataaccctatgtgccttggaatgctgtaatctgttttctccagctgaatttaatatcttttcatcatcatgggtgatgagcagtttcaccaagatatgtctgcttgtggatttccttgtatttgtctgaaccaggacacactgtgcttcctgagtctatgaattcttatatttcatcatttctgggaaaatcctcagctattttttctttagtattttctcttttcctttctttctgttctctcattttggaattctagttatatatgttggactcatctctccatgtctcttcgttttccttttaaactttgcattttaaaatttattttagtacattctggaattttctcaaatctatattctagtcttaagatatatctaaatgctatttatcccacctattatgtctttaactttagtaactgtattttttatttttggaaattctctttggttgtttttgaaacctgatttgcccttttgaatagtgccttgctttttttcttatgtttttttaattctgtatgtttttagtaattttaagcaaaatttttattgtaatttagtatctattaaaattttattatcaaaagttcttgataatgcttttgaaaatgggatctaattttcctcttgctaataaggatttttatgtatatataaaatagtctgtattagaagcttatcttcaatgatctttttcccttgagtatcctttttgtcattgaggacatgttttctagagaggttttgcatctgtttctgacagatgccccagggttatcaaaattctggtgctactgctgtataaataacagaaggggtatttgaggaccacccaggtaatataagttagagccacttaatacatgtaggatatttctcattatttttaattttccagggagatatttgttttttcaacaagctctcttgccaagacaggcaaactttcttattctttcctgtttctgatgggttgatgtttttctggcccttcaggggccccagatctaggtaggcagctcatttaaaaatccttgccttatctcaaatacctgttaaactctgttcccttgattcattaagagtgctgaccctctcaatttaatgaccctaaggtcattaacaacctcagttaatactttgtgttttagttccttcttttgaattttgaaacttagactgttatatggtaaaatattgacagaatttaattcttaattgtagttattcagtgtttcttttctgtttttcttttgaatttattcctgaaaatatttgaatctgtaaagattttcaatgatttttaaaaatatttaccattacctcaaatatttaccagagatatcataaaacttaatactatataccagaaaaataatagttttataagactactgacttatttatattttgttactacttctaaggtcaaaggtctttcatattttgtgttactgatttaatttatcacatgatggagagaaatgtataatatggacaagtaccctttttttcattgcccttggttgttagtgtttgctcttatttggttccctgccaacttttccattttaaggtatttttaatacatcatatattttagcactcccctatgagagcacatcagatgttatatgtttctcacattggtcattttatggaatttgagctattaggctataattatgatgtctctcaggatctcaacccttcctctgtagtcacagattttaatacttcttccggttactctctactcaccagatctcttaattctttagaattgactttcttgaaatccaatacttatgtgtcatagaaccagatgatccaatttgcttttttggcagacaccatatagagctctgctcattgcaagtttaacaaaagaccagagtattctctggactactctgataaaaacaaaaaatggtgtagaaagacttgaattttaactaggctttttcatgagataatttatgccaattctctgatttgaactttatcattttatgatataagggaataataagggcatatttaaaaggaatattaagttaatagcttgaagggaaatttgaggtatggcttgctaacgaaacataaatgtattattagttgataaaatgaaaactaagaatatacgcagtggacttgaagatctataccagcacaaactttgctttctcaataatgttttccagtttcatcttttaccatgtacttcctttgaaattaataatttttttattattatactttaagttctagggtagatgtgcacaacgtgcaggtttgttacatatgtatacatgtgccatgttggtttgctgcacccattaactcatcatttacattgggtatatctcctaatgctttccctccccccaccccacaacaggccctgctgtgtgatgttccccaccctgtgtccaagtgttctcattgttcaattcccacctatgagtgagaacattcggtgtttggttttttgttcttgcaatagtttgctgagaatgatggtttccagcttcatccatgtccctacaaaggacgtgaactcatcatttttatggctgcatagtattccatggtgtatatgtgccacattttcttaatctagtctatcattgatggatatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactaatttacagtcccaccaacagtgtaaaagtgttcctatttctccacatcctctccagcacctgttgtttcctgactttttaatgattgccattctaactggtgtgagatggtatctcattgtggttttgttttgcatttctctgatgaccagtgatgatgagcattttttcacatgttttttggctgcataaatgtcttcttttgagaagtgtctgttcatatcttttgcccactttttgatggggttgcttttttcttgtaaatttgtttgagttctttgtagattctgcatattagccctttgtcagatgagtagcttgcaaaaattttctcccattctgtaggttgcctgttcactctgatagtagtttcttttgcagtgcagaagctctttagtttaattagatcccatttgtcaattttggcttttgttgccattgcttttgttgttttagacatgaagtccttgcccatgcctatgtcctgaaaggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattaaaaagggaatactttccccatttcttgtttttgtcaggtttgtcaaagatcagatggttgtagatacactgcattatttctgagggctctgttctgttccattggtctatatctctgttttggtaccagtaccatgctgttttggttactatagccttgtagtatagtttgaagtcaggtagcgtgatgcctccagctttgttctttttgcttaggattgtcttggcaatgagggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgtccttccatttgtttatatcctcttttctttcgttgagcagtggtttgtagttctccttgaagaggtccttcccatcccttgtaagttgtattcctaggtatttttttctctttgaagcaattgtgaatgggagttcactcatgatttggctctctgtttgtctgttatttgtggataagaatgcttgtgatttttgcacattgattttgtatcctgagactttgctgaagttgcttatcagcttaaggaaattttgggctgagaggatggggttttctaaatatacaatcatgtcgtctgcaaacggggacaatatgacttcctcttttcctaattgaatatcctttatttctttctcctgcctgattgccctggccagaacttccaacactatgttgaataggagtggtgagagagggcattccctgtcttgtgccagttttcaaagggaatgcttccagtttttgcccattcagtatgatattggcttgggtttgtcataaatagcccttattattttgagaaatgtcccatcaatacctaatttattgagagtttttagcatgaagcgttgttgaattttgtcaaaggccttttctgcatctattgagataatcacgtggtctttgtctttggttctgtttatatgctggattgtgaaattattaataattttaaatttcaggtaaaaatattctgctaaataactgatgaaagctgggaatacataaagaagaactaaaatagaggccaaaagctgttttggtgtcaacttgccctccaggtccaattctggaacctttgttctcattgtgtagccttagcccagtacttgaacttcatttccttacagataataatggggctattaacagtccctactttacatacaggattgttttcaggaagcatttaatatctcacacaaaaaccttaacagctggacatggtggctcaacacttgtaatcccagcactttgagagtcctaggcaggagaattgcttgagcctaggagttcaagaccagcctgggcaacgtgaggagactctgtctctagaaaaaataaaaataaattagccaggcatggtggtacattcctgtggtcccagctactcaggaggccaaggtgggaggatcacttgcgcccaggagattgaggctacagtgagccatgattgcaccactgcactccagcctaggtgacagagcaagaccttgtcttaaaaaaaaatgaattaacattgttcttagaccttaaaaagaaaagaattcaaagactaaaaggatatgcttatgaccctaatgaggtcagcaagacagcagttatcaaatagaaggtcagatattaaaaataggaaatgaaaaattattccaaaaaatagtaagattattggtggtaacaaaagtgatatgaaactatttgcaagaacaaaaaggagtaaaaatttaaaaattaatttgttaaaaagtcctgggatgatactaatatgaaattgcttaattacaccttaatttctcaagatgttttcatcttttgtaaatcttatggaattgaagttaagaaacgatgactgtaaaatatgcaaataggcactctcaaaataataatgtaattttgccatacatgtttgtagtacaaagacttgtacaaatttaatgaaaattgtctttgaaaataatgaaatggctaataatcttttactctatcttttagcatacggcggcatcaagaaaggagagcaattttgacccccgttttgacagatttttctgtccgaataactggagcacctgctgtcattttcaccaaagtagtttctccagaaaatttgcatactgaggttagaacataattttgattttattttagtctaaataatggaattgctcctctttgtatgttagggattgccacagtttcagcccataggacttcaaattagctcattaataataatggctactatcatagctaacatttatggagcactttgtagtactcttcagttattgctttccttgtaataactcatttagtcctcataataatcttatttgctactcctcatatccgtattttgtagatgacaaaactgaggcatagaggagctaaccaagctacccagattgttatgcataccttagttgcctcatatatagctactcttgttgccctctagattgtcataaggttcaaactgatcaatagaagaaataattataagaggaatctgagaagctaaagttctataaaaatgaaaattatccttgtttttatattattagctgctaatcctaccaattgcattcatactatttaacctactagtataagatcaattatttgcaagttttcacaggatgtatgccaccaataaagccaagttatttttagtacaaatttttgtgctcttgggtaatgttacggtgactatttttttttaatcctgaattggtatacttttttccctttttgtcaatacttgaggaatagaataagaattctaactagagtgaatgaatacagagaacttgtggaggaaaaaattgtttaaccaaaaaaaaaaggataattatttcagacatgctgttcttcatggctttattaaaagctgctctaagctgtctcatttgcatttggactagtcatagtctccttaaatccattcctctggatgatactataaggggaagatctgttggacatttccaagcatttgaacattgtccacatgcacatcatgacaagaggcaggacttattaagtgaaactattgtattggttttttgttttgttctgttttccttgtctgaacggttttccagtgataaatgttcaagtgactaggttttgcagaacagcaccaattaagttatggacatctacccaatgctgccaagattttagcagtttaaagaagtgaaattaattagtctagctgtctttagcttcaacactccgttttcttataaatcatttagagtatatcctttggagaatattcatactgtggctcttagcaattaattgcctgcctaaaattgtctgtttacatctgtctgcccaactagattataacctcctcaagagcaggttgcccttcaaggccgacattattctttgtgatattcataggactctactatcgtacctagtacttaggaaatgctcagtaaatattagttggtttgaattcatgaacaagattatgctacacaattatattgttgctacatattgaaaacaataataatagttggagttatggaaaagtcaaataggtatgaaaaggtgaagacttcttattgttagttgtgtatatctagcacaaggcccaacacacagcaggccctcataaatatgaaattcatctgttaaattgtgtcaagtggctgtgctcaccatttttgctcttctccttaatgtatgaacttgagtcctaggaaatgtcaccaaagtagtgaaggtcaaataagtaagaatgataaattatcatctgaaagctatcatgtttctttatctgtattctaccgtttttgcttcaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgatattctttattttagaaatttgtttggtctctattcctcttatttatcatgtacctttgcaaaattgctgtggactgacctcagaggaacctctgttatatacataactttattagcctgctgaagttctaaagtatgatgcgagaatcctggtatagctttcatttactcggatacattacagtaataaggcctcttttggaagtgaactttctaagagtactatgggaatatcttcaataaataacttgtaaagcatttgtttcccatgctcagtgggaaatgaatggacacaatcataaaagttgaatgcctgcctagaattttaattttgatacagtgttcattggaagcctgtattgtaaccacaaagtatgtcagcaagaaacaaagaaagctatttgttagattcttctcaagatatattttctttgcattttgtttccacatttctctaacattctgtacttagaataaatattttataaaaactcaggtgaacaaactgtttatatatgaaaaagatgttgcttttatttttgtcatgagttgtaaagaaagctttaagttctgtttagtaagaaggtaggaaatgaagaggaatttaggtctcaagtcagcactgtttccattctgccacagattatgtattataactgtgacattattctttcagtcttctttatttttaaaaaaattattttaaaatgataaatcttttatcttttgtaaatgattttctaatgtaatcatcctttactagccatgatatctatttattcaatatctattgtaaaaggactttagaactacatattgtccaaaatattgagtttttaaatatacattagggaatccataaaaatgtaattatatgacatcaaaataagcaaattaaaaaatatttccccatgcattttcgatgaggcctctgaagcaagttgagttggataaaagtaaattacattcctatattatttgtgccaattttataaatgtctcctgtcaaagaaatctaactctcagatcactgattgttttaggattcacataacttagcaaattggttattaactatttatctacatacttttaatgcctcttagggggatcaatttcagtaaataaagggatactcggagttactaactatccttccctgaatgttgaatcattactgacaattccgtaaactatataggcattgttttcttctgctttaaaaaggtatctgtggctatgtgtttcttcttagagatcatattacaagtacagatgacatgaacatttttaaatggttaaaatggtaaattttatgttatgtatatatatcacaattaaaaaatacaggctatataatgagaaaggactgtttggaccttttcccaaccctggtgggacatatctgtaaaactttccgtattttagaaaagacctacagtgcactggaagaatatgattcaatttttaaattattagcagaactcatatctgctagtctatgaatataaagacattttagttacatagaatactccataataagtcaaaggtatattttgaaagggctagttgattgcctttagtgtggtttcacaacaacactaccagaatttttttttctttttttttgagatggagtcttgcactgtcgcctgggctggagtgcagtagtgcgatctcagcccactgtaacttccacctctcaggttcaaacaattctcctgcctcagtatcccacgtagctgggattacaggtgcctgccaccatgcccagctaatttttttgtatttttagtagagacggggtttcaccatgttggccaggctggtctccaactcgtgacctcgtgatctgccctccttggcctcccaaagtgctgggattacaggcgtgagccaccgcgcctggcctttctttctttctttcttttttttttaacacggagtctcactctgttgcccagactagagtgccatctcagctcactgcaatctccacctcctgggttcaagcaattctcctgcctcagcgtcccgggttgctgggattacaggtgcatgtcaccatacccagctaatttttgtatttttagtagagacgtgatttcacaatgtcagccaggcttgtcttgaactcccgacctcaggtgatctggccccctcagcctcccaaagtgctgagattacaggcgtgagctactgtgcctagccaacaatttttttaaaaattccttttgagaacaaaagaaaaataggaaaattaaacctggctaagttattgggaaaatggaggaagatatacatgttagtatatataatataatcctgatattataaacaactactatttcataggaattatggattaataataagaatcccatttatcaggttttctagaaggcaccctgtgaattatagaccagtaaatgtcaaatctgttctaagtccaccatctgatactatgttgatgcaacatagttctataagaagaaattatgtatatttaattatgtataattaatatatataacattaaatatatatatatatatttcttttcttttcttttcttttcttttgtttagtagagatgaggtttcaccatattgcccaggctggtgttgaactcctggcctcaagggatccatctgccttggcctcccaaactgctgggattacaggtgtgagccaccacacctggcctaatgtagtatattttttgaaggtgttaacattttcagacaacctttggcaatatttatttgaaagattaattttggctgggtgcctagtggctcacacctgtaagtccaacactgggaggctgaggtgggcggattgcttgagcccaggagttcacaatcagcctgggcaggatagtgagtccccatttcaacaaaaaaaaattaaaaattagttgcatgtggtggtgtgtgcctgtagtcccagctactcgggaggctgaggtgggaggatcacttgagccccagaggtcaaggctgaagtgaggtgtgatggtgccactccactccagcatgggtgatagagcaagagaccctgtctcaaaaaaataaaaggaagattaaaaattattcaagaataatatcacttgggaggccaaggtgcgggcagatcacttgagcttaggagttcaagaccagcctgggcaacatggcaaaactgcatctctacaaaacacacacacacacacacacacacacacacacacacacacacacacaaattaggcaggcatggtggcatgtgcctttagtctctgctacttgcagggctgaggcaggaggatcacttgaacctgggaggtcgaggctgcagtgagccaagatcacaccattgcactccaaccaggtaacaaagtgagaccctgtctcaaaaaaaaaaaagtataatatgatagggggattatgtattagtggaggaaacatctattcaataaacaaaggggaaaaatgcacatatctttgaaactagaagtgaaaaccgtaaagtaatctgaggattcttgccagaaccaatatttaatattaattttaattaaaaagacaactaacacataatgaaatttaccagttcacagccaaaatgactggatgatggattaggaaaattgtctcccacattaaacaaaaattttccaatatttttgctctgaaaaatgtgttttagatggggtgaggccactagaccaatgggcctgtattcatactattagattttcactgtccccttcaagtactataatttccatgatttctagctcccagaatatttggtttctgcctttaaatgaaccttatttctctatacatacaggttgagtcccctatctgaaaactcaaaatttgaaatgcttccctgagcattttctttgagagtcatgtcacgttaatactaaaaaaatttcagattttggagcattttggattttgaattttccaattaaggatactcaacctgcgttatgacaggctgagaaattacataaaagaaacaaatttaatattcaaaaatcaaaatgcattccatattacaaagtacatttccttccttatctagctcgctgcgatagttcaccatcccattctatatttcatgtttccgtgacatctggctctagaggactagtacaacaggcacgttatttgggattcttacatgttagttccttgccttttacatgaggtgagagtcaaccttttggataccttaacagccaaagccaaatttacaattctaagtttactcccaaaacagagctccactactcagccttgatttcttaaccagtgtttaacaggactgtggttgacacaattggtttacccttcagaaggttctttaccttcttacaagatagtcttagtctcataaaggcccaattatataatcatgggcattagtttatttattataatatggttttatttttatcaaattagtaagtgaattttaacaaccaaattttgctaatgaaatacatcaaagtagcatcaatccctgataccctcacctcattctgcccaacagtcagccactctttataagctgtttcttcaagtatttatttccatatttctaaataacctgaatggcctatcatatcttgattccctattaccgtattcacttgctatttgttgttaataagggttctatctcttctgcacttcctttctacacttccatcttcccagtattcttatatcatattcttttttgtcaatcttaattgtcttcattataaagatgatataaatattgttcattgcttagtgaattaatgtagtgtgataatatttcttgtcattttactattgaagttactcattgccacattttcttttttttcttttttctttttttgagatggagtctcgctctgtctcccaggcaggagtgcagtggcgcaatctcggctcactgcaagctccgcctcctgtgttcacgccattctcctgcctcagcctcccgagtagctgggactagaggcgcccgccaccacgcccggctaattttttgtatttttaggagagacggggtttcaccgtgttagccaggatggtctcgatctcctgacctggtgatccgcctgccttggcctcccaaagttctgggattacaggcgtgagccactgcgcctggccactcattgctacattttctatttactcagttttttaaaaatctctgtcttccctctcactaacgcacaccccattcccatcagtggctctaccataattcctcgcaatttaatttttcacactgtaaaacttatcgaatagcatcacctctgcttttccccccagagccatttttcctgaagttctttttctgccttctctgttctgggactgttagttctctagacctgcggcacacttggcataaaacagccagatgagagaagattgtgatttgaggttggtgtaaagaatgttagagaaaaatctagggaacaataaaataatgtgttcttctattaatataaattagtaaattgaccaatatctttattctttcattctaaaatattaagtattattatttactacattaaaaagtataatagtatagaaaaatgttgtctggctaatatctacttggatatttaaagttttttatgaaatagaaaataatgcattgggcttttttgctatgaactgtcattgagcttatgccatgtgaagtgatggtagaggttgtttggggtggtattttactgttttaacttagaaataatcagttttgtagttgtgcttcattttaggcatagaaattcttgtcttttagtagaaagtgaaaaattctccaagacattcttgaccaaactaaggattgtcagaaataattagaaataggaacttgaaggtaaagaagaaggaaagggactttaattgtgtggttgcgtaataacagatgtcttctggaatagaatttcaggtaagatgagggatatagaggaaatgaataaccaaaatgcatgtgggtaaaggggggtttgagagaggaaactgagactggcatgaaggagtatgtcgattttctggtcggtcttgctgcttactctcttgaggtagtcatgaatggaaaaagccagatcagaggctacatatttctgtatttaggaaaggagatgggaattttggacgatatgcatagggtgacctcctattggtgttgctatgctgagtattttgtttcctttcagaggcacctggatagaccacttgtaaccaggcaataaacacagactccagtaaaatatggattcaagcagagccttaaaaggacaagaggggctgtgacggaatacctcaaatttcttaaaatctaggcctggaaaagatattaagtattttactgcctatcttctccaagggaaggatttcttaggtacattgaactctcacatctgtcacaattttagttaggccttgtcaacgttaaaattagtgtaattttctcctgataaacaagcttgtgctgagacaggaaaacaccacagttgcctcaaagtagatgtaagacatcaagaagacaataaaattttaaaattttcagcccccatgatgtttatccctatagatttctttgccagaaatccagtaaatgcgttaagttttcctcaggctccagtaaactgtctacgctagtcttattaggcattgttcattgagagcttactatatgccagatacactggctacagtctgacagaggtttgaaaaataagtacactatggtctctgccctctaggcttttataatctggttgggaagtaaagcatagacaaatggaatgataactaagaactcagagcagtatatgaaaagtgttaaatatactctatggaaaattagacttatgagtccagggaagaaagagaaggctttaggccaggtgatcaatgatctagcttcatggagaagtggaatacatagaaaagagtagcctatttatttattcaataaatattgaatgcctcctatgcgtcaaatactattatggatactagggtgacagcattaaacaaaagaggtaatatttctgctttcatgtctaatgcacatatatttagtagggaagacagacaataataaatatttggaactacctcaaaatataaatacacctactcgtgtgcagagattatatagctttacattttctgtaactgacttaatttttcttacaagcctaaacttcatttagattaaggatgttggttgttagagaagagaagcagtaagggagtatacattaaatttgccatcaataaaaaatagtttcaacatggagaaatagcatgaataaagacgtggaggtttctaagcattaggattttttggtaggacagtgaaaaaaattaatctttctagagtgaaggaactgtgcagggaaataatggaagatacactaagaagtgtatattttatcacgagcagttgggaaccaaagtttatagacttgaatgaatggtatgacatagaagaaatggtattttaatgaaatttgttatgcttagtcttttttggcaaaggatttgaagtggcattcaataaaacataaaaaatgaaaactgcagactaatacctctggagaatatggatgcaacaatcctcaacaaaatgctagcaaactgaatccagcaacatagaatgaattatacactatggccacatgggattacccagaaatgcaaggttggtttaatatctgaaaatcaattaacgtaaagcactatatcggtagaattttttaagtcatatgattatctcaataagtgaaaaaaatttttagacaaaatccaataccctttcataataaaaacatgcaaaaaactaggaatagaagggagcttactcaacttgataaatcacagttatgaaaaactcacaattatcatcatagttgatgataaaagactagatactttccccctgaaatcaacaataagacaagaatgtctgcttacatcacttctatttaacattgtactggaagttctagttggagtagttaatttcacccagtatgcttccaatcccttactatgtttaactttataagcaaaaactgatcatatggaggtcctcttacagaatgagagactcttagaactgtcaggtacttcagaaattgtgttatttaattgattcattatcattcattagcccacatgagagtgaaactctacttagcctcctgctgccctctgtgagccttcttgcactccccactcctcttttcagtggacacaaccagaaaacctcaagtatcctcagagtttgacagaaacgggagagggtataagcttgatgccatattaagctgttttccattggatgaggaaagcatagcttcctgtttgttaaaacaggatttctgttttcttaaaacagtataggttcctgattcttaaatttcttcctgataacttcttctcttaaatccacatgatttttctgatggaatccttgctagaaagccaagttaaggcctcagagctgttcatttatttgccatccacccttcagaaaattcttagactgggtcagtcagcagtctatatctatgcacttaactcactgtccagggcacccaatcatttatagaagaggaagattcaacatagtaatgtctaatacctgagtcatcccgtcttcccaactagtctagtccttcttaatgagtcttactgtctgtccccctatttttctgttatggcctgacttttaatataaggctgattctgaatcagattaatcaaatgcatgttaaatttgagtggtggttttgtggggagagggaaaagatgggccagtaaaccctaaaacacagagcaattattttgcacatctttgaaagtgctttacaacaaatgaagaaacagtctatgctcatggatgggaagaatcaatattgtgaaagtggccatactgtccaaagtaattaatagattgaatgctattcccattaaactaccattgacactcttcccagaattagaaaagaaaactattttttttatactttaagttctagggtacatgtgcacaacatgcaggtttcttacatatgtatacatgtgccgtgttggtttgctgcacgcattaactcgtcatttacgttaggtattactcctaatgctatccctcccccatccccccatgacaggccccggtgtgtgatgttccctgccctgtgtccaagtgttctcattgttcagttcccacctatgagtgagaacatgcagtgtttggttttctgtccttccaatagtttgctcagaatgatggtttccagcttcatccatgttgctacaaaggacatgaactcatcctttttcacagctgcatagtattccatggtgtatatatgccacattttcttaatccgatctatcactgatggacatttgggttggttccaagtctttgctattgtgaatagtgccacaataaacatatgtgtgcatgtgtctttatagcagcatgatttataatcctatgggtatatacccagtaatgggatggctgggtcaaatggtatttctagttctagatccttgaggaatcgccacactgtcttccacaatggttcaactagtttatactcccaccaacagtgtaaaagtgttcctatttctccacatcctccccagcacctgttgtttcctgacttttaaatgatctccattccaactggcatgagatggtatctcattgtggttttgatttgcatttctttgatgaccagtgatgatgagcattttttcatgtgtctgttggctgcataaatgtcttcttttaaagtgtctattcatatcctttgcccactttttgatgtggttgtttgattttttcttgtaaatttgtttaagttctttgtagattttggatattagccctttgtcagatgggtagattgcaaaaattttctcccattctgtaggttgcctgttcactctgatggtagtttcttttgctgtgcagaagccctttagtttaattagatcccatttgtctattctggcttttgttgtcattgcttttggtgttttagacatgaagtccttgcccatgcctatgtcctgaatggtaatgcctaggttttcttctagggttttcatggttttaggtctaacgtttaagtctttaatccatcttgaattaatttttgtataaggtgtaaggaagggatctagtttcagctttctacatatggttagccagttttcccagcaccatttattaaaaagggaatcctttccccatttcttgtttttgtcaggtttgtcaaagatcagatggttgtaggtgtgtggtgttatttctgagggctcttttctgttccattggactatctgttttggtaccagtaccatgctgttttggttactgtagccttgtagtatagtttgaagtcaggtagcacgatgcctccagctttgttctttttgcttaggattgtcttggcaatgagggctcttttttggttccatatgaactttaaagtagttttttccaattctgtgaagaaagtcattggtagcttgatggggatgtcattgaatctacaaattactttggacagtatggccattttcacaatattgattcttctatccatgagcatggaatgttcttccatttgtttgtgtcctcttttattttgcttagcagtggtttgtagttctgcttgaagaggtccttcagatcctttgtatgttgtattcctaggtattttattctctttgtagcaactgtgaatgggagttcactcatgatttggcactctgtttgttaatattgtataggaatgcttgtgatttttgcacattgattttgtatcctgagactttgctgaagttgcttatcagcttaaggagattttgggctgagacgatggggttttctaaatatacagtcatgtcatctgcaaacagggacaatttgacttcctcacttcctgattgaatgccctttatttctttctcttgcctgattgccttggccagaacttccaacactatgttgaataggagtggtgagagagggcatccttgtcttgtgctggttttcaaaggaaatgcttccagtttttgcccattcagtgtttatcataaatagctcttattattttgagatacattccatcaatacctagtttcttgagagtgtttagcatgaagggctgttgaattttgttgaagaccttttctgcatctatggagataatcatgtggtttttgtcattggttctgtttatgtgatggattatgtttattgatttgcatatgttgaaccagccttgcatcccagggatgaagcagacttgatcatggtggataaactttttgatgtgctgctggatttgattttccagtatttttttattattattatactttaagttttagggtacatgtgcacaacgtgcaggtttgttacatgtgtatatatgtgccatgttggtgtgctgcacccattaactcgtcatttagcattaggtatatctcctaatgctatccctccccgctcccccaaccccacaacagtccccagtgtgtgatgttccccttcctgtgtccatgtgttctcattgttcagttcccacctatgagtgagaacatgcggtgtttggttttttgtccttgcgatagttttctgagaatgatggtttccagtttcatccatgtccctacaaaggacatgaactcatctttttttatggctgcataggattccatggtgtatatgtgccacattttcttaatccagtctatcgtttttggacatttcggttggttccaagtctttgctattgcgaatagtgccgctataaacatacatgtgcctgtgtctttatagcagcatgatttataatcctttgggtatatacccagtaatgggatggctgggtcaaatggtattgaggattttcgcatcaatgttcatcagggatattggtctaatattctctttttttattgtgtctctgccaggctttggtatcaggatgatgttggcctcataaaatgagttagggaggattccctctttttctattgattggaatagtttcagaaggaatgttcccagctcctctttctacctctgatagaattcggctgtgaatccgtctggtcctggactttttttggttggtaggctattaattactgcctcaatttcagagcctgttattggtctattcagagattcagcttcttcctggtttagtcttggaagagtgtataagtccaggaatttatccatttcttctagatctcctagttcatttgcatagaggtgtttatagtatgctgtcatggtggtttctatttctgtgggatcagtggtgatatcacctttatcatttttttattgcatctatttgattcttctctcttttctttattagtcttgctagcagtctatcaattttgttgatcttttcaaaaaactagcttctggattcattgattttttgaagggttttttgtgtctctgtctctttcagttctgctctgatcttagttgtttcttgccttctggtagcttttgaatttgtttgctcttgcttctctaattcttttaattgtcatgttagggtgtcaattttagatctttcctgatttctcttgtgggcatttagtgctataaatttccgtctacacactgctttaaatgtgtcccagagattctggtacattgtgtctttgttctcattggtttcaaagaacatctttatttctgccttcatttcgttatttaccaagtagtcattcaggagcaagttgttcagtttccatgtagttctgtggttttgagtgagtttcttaatcctgagttctaatttgattgcactgtggtctgagaaacagtttgttgtgatttctgttcttttacatttgctgaggggtgctttacttccaattatgtggttaattttagaataagtgtgatgtgatgctgagaataatgtatattcggttgatttggggtgaggagttacgtagatgtctattaggtctgcttgttgcagagctgagttctggtcctggatatcctcgttaaccttctgtctcattgatctctctaatattgatagtggggtgttaaagtctcccattgttattgtgtgggagtctaagtctctttgtatgtctctgaggacttgctttatgaatctgggtgctcatgtgttgggtgtatatatatttagtatagttagctcttcttgttgaattgatccctttaccattatgtaatggccttctttgtctcttttgatctttgttggtttaaagtctgttttatcagagactaggattgcaaccgctccttttttttttttttttttttgctttccatttgcttggtagatcttcctccatccctttattttgagtctatgtgtgtctctgcatttgagatgggtctcctgatgaatccagcacattgacgggtcttgactctttatccaatttgccagtttgtgtcttttaattggggcatttagcccatttacatttaaggttaatattgttatgtgtgaatttgatcctgtcattatgatgtttactggttattttgcccgttaaatgatgcagtttcttcatagcatcgatggtctttactatttggcatgttttcatggtggctggtaccagttgttcctttccatgtttcgtgcttccttcaggagctcttgtcaggcagatgtggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctgacttgcagggtttctgccaagagatcagctgttagtctgatgggcttcgctttgtgggtaacccgacctttctttctggctgccctcagcattttttccttcatttcaaccttaatgaatctcacaattatgtttcttggggttgctcttctcgaggagtatctttgtggtgttctctatatttcctgaatttgaatgttggcctgccttgctaggttggggaagttctcctggataatatcctgaagagtgttttccagcttggttccattctcgtcattttcaggtacaccaatcaaacatagatttggtcttttcacgtagtcccatatttcttggaggcttttttcttttcttttctcttttttctctatcttcaatcactgataccttttcttccacttgattgaatcagctactgaagcttgtgcatgtgtcacgtagctctcatgccatggttttcagctccatcaggtcatttaaggtcttctctacactgtttattctagttagccattcatctaatcttttttcaaggtttttagcttccttgcgatgcattcgaacatcctcccgtagcttggagatgtttgtcattaccagctttctgaagcctacttctgtcagctcgtcaaagtcattctctgtcctgctttgttccattgctggtgaggagctacgatcctttggagtagaacgggcgctctggtttttagaaatttcagcttttctgctctggtttctccccatctttgtggttttatctacctttggtctttgatgctggcgacctacagatggggttttggtatggatgtcctttttgttgacgttgttgctattcctttctgtttgttagaaaaaaactttttaaaaattcaaatggaaccaaaacagagcctgaatagccaagataattctaagcaaaaagagcaaagctggaggcatcacactaccagacttcaaactatgctataaggctacagtaaccaaaacagcatggtactgatacaaaaacagatacatagaccaatgaaacagaatagagaactgagaaataagactgcacacctacaaccatctggtctttgacaaacctgacaacaacaagcaatagggaaaggactctctgtttaataaatggtgctgggagtgctggctagccatatgcagaaaattgaaactgtaccccttccttacaccatatgcaaaagttaactcaagatggattaaagactaaaatgtaaaaccccaaactgtaaaaaccctagaagaaaatctaggcagtaccattcaggacataggcatgggcaaagatttcatgacgaagatgccgaaagtaacccaacaaaagcaaaaattgacaaatgggatctaattaaactaaggaacttctgcacagcaatagaaactatcatcagagtgaacagacaacctacaaaatgggagaaaaattttgcaaactaaccatctgacaaaggtctaatatccagagtctacaaggaacttaaccaaatttacaagaaaaaaaacaaccccattaaaaagtgggccaaagacgtggacagatacttctcaaaataagacatacatgtggtcaaggaacatgaaaaaaagctcaggatcactgatcattagagaaaggcaaatcaaaaccacaatgagataccatctcacaccagtcagaatggctattcttaaaaagtcaaaaaacaacagatgcttgcaaggttatggagaaaaacggaatgcttttacactgttgagtgggagtataaattcaaccattgtgtgagacagtgtggtgattcttcaaagacctagaggcagaaacaccatttgacccagcaattgcattactggttatatacccaaaggaatataaatccttctgttataaagatacatgcacgtatatgttcattgcagcactattcacaatagcaaagacatggaatcaacctaaatgcccatcagtgatagactggataaagaaaatgtggtaagtatacaccatggaatagtgtgcagccataaaaaggaacaagatcgtgtactgtgcagggacatggatggagtttaaagccattatgctcagcaaactaatacaagaatagaaaaccaaacaccacatgttctcacttatcagtgggagctgaatgatgagaacacatggacacaggttggggaacaacacacactgaggtccatgggtggaggggtgagggaggggtggagagatggagaatatcaggaagaatagctaatggatgctgcacctaatacctaggtgatgggatgatctgtgcaggaaaccaccatggcacagatttacctatgtgacaaacctgcacatcctgcacatgtaccactgaacttaaacgttaaaggaaaaaaaaatgcttttcttttgcatcaggggagttaagagagaatggagagaattgttgcagataaggtctgtttgttgatttttctcaggatatgagtctcgggggacatgtaagaaagaaaacatagtggtcaagaacttgagctttgttgttggagtccggcaataaatcccatctcctgtgtttactttctgtgtggccttggacatgttactttaattcatgtgagcttcaatttaatcatctgcaaaattgagataataatagtcttccccaatggggttgttgtagagattaattgggaagctgtttcttaagcattttccatagtgattgttatataataagaactcaataaaagccatcaccatcattgtcatctcatctagagatcgttaattttcatctctttttctatctactacattatatcttgcccaagatccttctcctgtttgcttgattatagagcatatatgactattgcttaatgtttttgagcttgattggataaaagaatgatgtaatattatgctccaatgtcctatttatcatctggcaggctttgaaagggtgtctgttccatagacttctgtccagttgataacacagtttgctccagcagcttattcctcaggtaaatgagatcttgctgaaactacagttgatagtgagatgcttctgtaagcactggggtttttttcaggtggcagactaacagaaggatgtgtgtatcccactgctttgctctgctcaccttgctcttttcactcaggattcactgttgacttttctcagccataggaaaggtttacataaccaatcttcatgaaatcagttaggactgttattaatgggtcactgtcaaattaattattgctgaaattttagctctttgcaatagatgaagcaactgttaaagctgcattgaaagacacttgcattttctcctcaaagattcattattcccagtgtttctcttcataagctctgtatggttagtgacccatatatgaccctctaaaattgttaagagcttcaaaagtcaatcctatattgagtgccctatatttttttgaactatttgttgggggttacatatagatgaaaaatgttaaactttcattaatataaaaatgtatgacaaagcaacagcaatcaagacaatatgatactggcataaggatagacatatggatcaatgaaatagaattgagagttcaggtactaactctcctgtttatagtcaattgatttttgacaaggtagtctagatcattcagtggaggaaagaatagtattttcaaggaataatgctaggatgactggatattcccatgcaaaagaatgaaggaaaatgcctaaatcatatcatatgtaactcaaaatggatcaaagacctaaatataaagagctaaaactataaaaatccttgaagaaactataggtgaaaatgttcatgatgtttgattaagcagtgtttttttagatatgacaccaaatcacaaaaactaaaaagaaaaagaatagataaatggaactttaaaaaccctgaagcttttatgcttcaaaggacatcacccagaaagtgaaaagacaacccatagaatcagagaaaatatttgctaatcatatatttgcagaatgggagaaaatatttgctaatcatatatttgataagggacttctatctagactgtaaaaaggactcttataactcaggaataaaaatgcaaataacccaatttttaaatgggctcaaagaatcttaataaacatttccccaaagatgttgtagaaataaccaataagcacatgaaaagtttctcagtattatgaaccatctaggaaatgcaaatcaaagccacaagaaaacaccacactgactaggatggctacagtcaaaaaaagtcaaataataacaagtttcgacaagaatgtggaaaaattggaaccctcttacactggaccagaatgtttacctacataacctactgctccagtgacatttggggcacatttgcaaaattctgagagttgaatagatcagcatttgacaactactgcactaaagtatcttctctgaaaagaattttgctgtaagttcttttttttttaaacagaaactatcatgttttgggttacatagctccccaactggagcctagagtagctaagacgtggtacttctgattaaagacagatacatacgcttaggaaaccagatggaaatggacaagttagcagagaagtttattgtgaaaataagggttagaacatttcacttggagactgttttagctgcatgtcacagacactcaaaatagatatgagtttctttttctcaggtaacagtccttaggtcagtagtctaagactggtatagtggctctgctccctaaggtcaatcagagaccctgtctcctctcttgttgttaatttatcatctctgaggtatctcactggcttggtccaagatggcttaccatgtctgtgttataagcagcagattagagcataggggaaatgaaacagaaagtagggacccctccctacaaggacaaactctgacgttgcgtgtagcagttatgctcacattccattggtcagaatttagccatgtcgtcacacccagctccaagtgaggctgagaaatgtagtcttttttcttttattctgcctgtataattgcagaatagaaatatagtattttacatgtgccctgctaaaaattgtttttctgctgtgtgccctgctaaaaattattctactatgaaagtaggtgacaacagatattggagtacaaccagcatccgtagctagagagtcttcagggttacctggtaggcagtcatgatattcctcagaaagcagctttggttcttcctcaatacttcgaacatatcctcaaatagatcctaaagttctatatcatataatatgtcagaaatagtgttagcttgcaaattgttcagtacgtctatagtgacaaatattgtcttttcctattggttctacccctcttcatctgacgatgaactcccttttctttaggtaaacaatagtttcctattccattgtggttttgatggggcttcccattatagggtcgccctgtgacactggcctggccaattgttgtactccatcctcctgacatttactgggtgatctgatcacagggcccagacaaggatagtgtttcatatgaagacagtgagaaaggtaaactgtctttcctgtagttaaataagtttaggtataatactgaagctttcattgttcatgctccatccttctttaccactgtcgtatgaagaaaacctgtcagtgttagagagagaaaaagagagaaggagccaaatgaacagaaataagcaaacttgagagacaaagtcttgatgacatcatctgattcccttgacacagttctggtcaatgaggtgtaaagagaagtgttctacagatttctgggaaagtctttactttctttctcctcctcctccttggaataacagtgatggaagtgaccagccacttgtgaccatgtgatgacaaacaagaggagaaaacacagtaaggataacaaagtggacagagaaaatggtcctaagatatcagtgacatcatgcagctactgcaccagccctaactttaggttatgtgagcaaaataaacctaaacagttaagtcgttggtatttggctcactattacataaagccaagcacaatccttactgatcagatgttcttacagtattctaagtctgagatgataaaacccagggaaaatactgagcacacaatggacttcaatgctgaataaatacttgctgagtgaattaataaatggattcctgaattcatagtaattctcatttctgttcctagaagtagaaaaaataagatgtatacaacatatacttcaaaagaattggaagaaattgttggctaactccatgtttgagggagacagataggttaagtacataccatggagtgctttgaatatcagattgaaatgttttgcttaagtcagtgagcaatagagagaagttggtgtttgtgcagctagacaatgacttaaacaggtgtgcctgaaagttcagatccgttttagtctgaagctctcagttgtgctcccacatcgataatagtcatctgtaattatgtgatcttcaaacataaatattatagttacattttacctgttgtattataatgaggacctattatctcattatttagtaaggaaatatctgtactatgtagtatcacccattgttttcagaagctacaattgttattgattatatagaagggcgagagtgctgagattgccctgggttacgttcatttggctgcagtaattattcatttattcctgaatagcaagtaatcatcttattaagtctacttacagaggtagtgtatgtaaagactaacacatgctcattttcaaatcagtgattcagaataaataaaacttttgtaggaaaatataaaccatgtttttaggggcaaagaatagaaccacatcattggagatctgatgtgggagttctttgatctctgcactacatatcctggagaagaaaataaagacaacttataacactaattgagcattccttcctttgccttctccccttcctcctcctcctccacttaaccacttggttttaggcacttccttagccctcccttcccttcagtccccagtgtagatccacttggtaacctgtccatgaatgtttggtgcctgttcttatgctgtctttgatagttaaaaattatgattttttaaagtaaaatctcatttgcaaaaaaaaaattactttagccaacataaaatatacagtacttagttcaccatttctaaacatttctaaagtagtggttatttctatccaatgtaaagtttccctttccccagactttttgccattatttattgtatttgacttctctacaactatctaaagaataaagaactacataaaacactatattcaactctctatgaagcatgataaatttacattttttaaaatattgtactcaagctggtaagaacaggtaaaactccctttgctccagctacatctccatctcagtcagcccctgtcctctcaaggttactattaatatctgccttcctgtctccccgggcctctcccatctactcctctgtaatttccatttcttcccattcatgctaaattatgtcatctctctgaccctgaattttctcttgaataattgttttttcctcacctactgttctctgatttctaatgcttttaataccatgtacttgtgacacacaaaaatatttgtgcagaaggaggaaagtcctaggaaaatcggttctaactaatttatgatcttttccaagtaaaaatgtgacaaatgagcaggctgttcaaaataattaagggtccgtggtttgcttggtttcctatctgagtttgtacttttctaacaagcaacttctgggcttttggttactattacataaaggaatagacttttaagaaaaattaacattagagccatggaagtgtatataattctcatctaagatttcagacatttttagattgcttatttctagaactttggctcttcctcaaaggttttccacagcaaatgacttaaaatcctctcagataatagaggaataaaaaataaacaccatggcttaaaccccgtaatcttccttctacattttttaagattctcggactttagcaaatgccacaggtggcccctcaccattctttctgaagactggcccatttagtagtgtacctttgagagacaaaaaatacactggggagatggaaggctttgatgatgctggtggttacccaaatgtatacatttgtccatgcccattcaactgtacatttttaaagggtgaattttattgtttacaaattatacttcagtaaacctagctttaaaaattgttgggctactcagtgcagcttttgtcagaatgtgtattacttaggcaactacccaggatccataacaccataacaccagctaacatattgggaactcaccctgtgtgagacagtagtctaagtgttttatataggttaactcctttaatcttcataatcactctctgaatttggggttacttttcagattggatagatatggaaacaaagtctcaaggaagtcctgtaacttgtacctagctaataattatcaaagccaggtgggcaggcacactctctcacatacacaccccacttgagaatatattggttagaagcactacagtttagtgacctaaccggtatggatgtgggtgttcttagggtcagttaagcaaaaatgaggctttacaaggccttaattgtccttgtatataatttgcattttattgaattgcaatggtaagccattgaagagtcaaaaacaagagaatgacatgatcagattcacatttggaatagtggcaggtggactaggcagggagacccagcatggtaatctcctgtagtaattcagataacgaaagcataaattgaagcactcatttggggaagagaggagaaaaaccagtaatgggctaactttgcatttgcctgagaggcagtgtctcagcacatgtattgaagcagagcgagtgctggagagctttctttctccagctgttccaaattggataacaaaaggcaatgactcttctgtttacatgtttgcttgtaggcatcagctattcctaaactggaaggcccctgattggcatctccctgcactttgcaactttattgaactcttaaccagctcactgtttcctttataccctaaataaaaatgttagactggactattgtctttttaaagtttcaaggagaagctttttatttgttttactggtttcctttttttaattttttttattatactttaagttctgggatacatgtgcagaacgtacaggtttgtaacataggtatacacgtaccatggtggtttgctgcacccatcaacccatcatctacattatgtatttctcctaatgctatacctcccctagcccctgaccccccaacaggctccagtgtgtgatgttcccttccccgtgtccatgtgttctccttgttcaactcctacctatgagtgagaacatgtggtgtttggttttctgttcttgtgttagtttgctgagaatgatagtttccaccttcgttcatgtccctgcaaagggcatgaactcatcattttttatgactgcatagtattccatggtgtatatgtgccacattttctttatccagtctgtcattgatgggcattcaggttggttccaagtctttgctattgtgaatagtgctgcaataaacatacgtgtgcatgtgtctttatagtagaatgatttataatcctttgggtatatccccagtaatgggattgctgggtcaaatggtatttctggttctagatccttgaaaaattgccacactgtcttccacaatggttgaactaatttacactcccaccaacagtgtaaaattgtttctatttctccacatcctccacaccgtctgttgtttcttgactttttaatgatcaccattctaactggcctgagatgatatctcattgtggttttgatttgcatttctttaatcaccagtgatgatgagcttttcttcatatgtttgttggctgcataaacgtcttcttttgaaaagtgtctgttcatatccttcgcccactttttgatggggttgtttctttcttgtaaatttgtttaagttctttgtagattctagatattagcactttgtcagatgggtagattgcaagaaatttcttctattctgtaggttgcctgttcactctgatgatagtttcttttgctgtgcagaagctctttagtttatttagatcccacatttgtcaattttggcttttgttgccattgcttttggtgttttagtcatgaagtctttgcccatgcctatgtcctgaatggtattgcctaggttttcttgtagggtttttatagttttagttctaaaatttaagtctttaatccaccttgagttaatttttgtatgaggtgtaaggaaggggtccagttcagttttctgcatgtggctagccagttttcccaacaccatttattaaatagggaatcctttctccattgcttgtttttgtcaggtttgtcaaagatcagatggttgtagatgggtggtgttatttctgagacctcttttctgttccattggtctatatatcaattttggtaccagtaccatgctgtttaggttactgtagccttgtagtacagtttgaagtcaggtaacgtgatgcctccagctttcttttgcttaggattgtcttggctatgcaggctcttttttggctctcaccactcctattcaacatagtattggaagttctggccagggcaatcaggcaagagaaagaaataaagggtgttcaaagaggaagagaggaagtcaaattgtctctgtttgcagatgacatgattgtatatttagaaaaccccattgtctcagcccaaaatctccttaagctgataagcaacttcagcaaagtctcaggatacaaaatcaatgtgcaaaaatcacaagcattcctatacaccaataatagacaaacagccaaatcatgagtgaactcccattcacagttgctacaaagagaataaaatacctaggaatccaacttataagggatgtgaaggacctcttcaaggagaactacaaaccactgctcaaggaaataagagaggacacaaacaaatggaaaaacattccatgttcatggataggaagcatcaatatcgtgaaaatggccatactgcccaaagtaatttatagattcaatgctatccccatcaagctaccattgactttcttcacagaattactggttttatttccaaatatgaaaaaagacaagcatgttgaaatgtcagtgggaagaatccaattgaaagagagattggaatttattggaatgagaaggaaaaaatgatacaacgacattcctaaattagtggagaattgtatgtccctaaaaaaggcagagaggttaacattaggatgcaggatatttcttctaacataaccgaaagtaagagggaagatcaccacagatgcaagtgcagcacttccctcttatctgtgggtgatacattccaagacccccagtggatgcctgaaactatacatagtaccaaaccctgtttatcctatgtttttcctgcacatacatatctatgataaagtttaacttataaattagtcacagtgagagattaacagtaactaataataactaataagatagaacaattataacaatgagccagcatcatcataatgcttgtcctttagggccattattaaaataagggttacttgaacacagcactgtagtacaggaacagttgatctgatcatcaagatggctactcagtgaataatgggcgggtcatatataccacatagatacactggacaaagggatgattcacgacccaggctggatggagctggaaggtgtgggagacttcatcacactactaagaatggcatacaatttaaaacttacggactctttatttctggaattttccatttaatattttcaaaaccatagaaagtaaaaccatggatgagagaggacaatggtagattcacaggttttgttaataggtatttgaaacatgcccatttgatgattttttcctctgtgaactaagatgtaaggccatctattaaggaataagtagggcttacaggtttgagatgggtggcaggaacctgcttattctatttaaattttaacttttagcctagtaaatataaatcaaaatctagaaaaatacttacaaataatggtgaaatataaagatttctaaaatttaagactggaggcataaaaacacaatgtaaattcaggccacaaggactgaacctcaaatttggctctaaacttcttggcagcccaaaaaagaggtagattcagttactaataaatcgcttaagagtttactaatttttggaatgtagctcttttaaaatttttaatattagaatggtcttagatttacagaaaagttatggaaatggtatagaaagttgccttatatactgtacccagtttcccttcttgtcaacattctacaataatatggtacattttcacaactaatgaaccaacagtgatacattattattaattgcagttcatattttatttgcatgttctcaatttttgctaaagacactttactaacatcctttttctgttccaggatcatcctggataccacattacgtttggttatgtctccataggttcctctagaatacgacagtttctcatagtttccttggtgttttttttttttttttttttttgagacagagtcttgctctgtcgcccaggctggagtgcagtggcatgatcccagctcactgcaagctccgcctcccgggttcacgccattctcctgcctcagcctcctgagtagctgggactacaggcgcctgccactgcgcccggctaatttttttttgtatttttagtagagatggggtttcacagtggtctcgatctcctgacctagtgatccacccgcctcggccccccaaagtgctgggattacaggttccttggttttgatgagcttgacggtttttagcagtactgctcagatattttgtagaatgtcttttaatttggatttgtctgatgttaagggaggagtatctacataaatcacatggaattcttctgttcaagggatttgtctattctccttcatataggatacgtgttataaataaaacattttattgaaagatgtgtctttaactctcaaaaacatttaaaaatcggttaatagtacagattgcaactgtaattaattccttctatgccaggcatttctaagtctttcagagctttagtcttttcatttgcaatatgtgagatttgcactatgttatttggccttcacctcccttactagtctttcattagtgatgttgatgacctgagggaaaacccatgactgacctccagtggtaatatgtgctgtggtccaagaaataaatgcctatttgttgacttgagatgagttggagcaactaggtagttaagaaaaagtagcacagatagactgcttctaattgttgatagttcatgaaaagtttcaattgtctatgaaacgactagagaagtttctttctagaagtaacccataaatgtctctttcttctaattttgtgaaatttgagccatttggtaaaaaaaaatgagtctaaacactctattcttcaatctatagataactctaatcctagatataatcatttcataaatgtttctcctgcttaatttatctcctcaacattttagaagagttttggcagtcattaattttagttctaaaatattttctgaaattaacttcccatcattctagttttttcctcaggcatctctcttttcatggagccatattcacataaattctaagatctttccctttcaatagccttggaagatatttgtgaatctttggaatgtgggtgtctctctatctgtgataattcctctaatattgcttttagcattctccagggcaggtgggtggatctaggttctctggggcctgaagttggtcctttttaaaaagaatacaaattataattacaaaattaggttcagggtcataaaatggcctgtgcaagtaagaggccttggagctgaaactttttttgtttgtttgcttgtttgtttgcttgttttgagacaaggtcccactgtatcacccaggctagagtgcagtggtgcaatcttggctcactacaacctctgcctcccagattcaagggatcctcccacctcagcctcctgagcagctgggactacaggcgcatgccaccaaacctggctaatttttgtattattttttttttcggtagatacggggttttgccatgttgcccaggctggtctcaaaactcctgggctcgagtgatccacctgccttggcttcccaaaatgctgggattataggcatgtccagcagcccgggctgaaacttttttaatattttggtaaatcttcctcaaacagcctcaggtgaaaactgacattactattatattcgtgttctcttgctgctatagaaattatcacaaacttagtggtttggaacagcacaaatttatctttcagttctttcagcagtctgacacagatgtctcactggactggaatctggatatcaagccagatgtcagtcccatgtgctctggaggctaaggctgaaggatcacttaagctcaggaattcaagagcagcccagacaacatagcaagactcagtttcaaaaaaaaaaaaaaaagaaaaaagaaaaagaaaaagaaaaaaaagatgtcagcatggctttgtttgcttcaggagggccataggggagaatccatttccttgccttttgttttctttttctttttcttttctttttttttttttttttgagacggagtttcactcttgtttcccaggctggagtgcagtgacgtgatctcagccactgcaacctccgcctcccagattcaagcgattctcctgcctcatcctccgaagtagtgggattacaggcatgcgcaatcacgcccagctaattttgtattttctagaggcttcctgcattatatggcttatggtattcttccttcatcttcgatgccaacagtggcaggtcaggttcctatattgtattaaatatgtctctgactgctcttccatcattacatgtctctttaagcacaggaaggaacagttctcagcttttaaagacttgtggttagattggacctacttggataattaaggataatctccccatttcaagatctataaccttaatcactctgcagagttcctgctgccatgtaaccaacaaaccttcaatttgtaaaaaacacagtatctgtgaagcacaataaagccaaatgcaataaaaagaggcctgtttatgttagtaaaaatgaaagagaaagtatataaccttccctcttttccaagagaacattaaacaaaattataaaatctttgtgaatacccaacattgtaactatttccggagctccttgatgaaaattgtttcatttcattggtctagagagataatctggatagatggagcccaagattaatgaccaatggtagtttatcttatgcatctaagataccatgtgtattttaaaagaaaactttagtctcttaactcctctcccacacgtaagaaatgtggtagtttcatacactgttgggcctagacctgtttcagattgtcccaggtatttccctcactcccattaccctatgattcttttcagttaagtgtctttaagagatggaagctcaaaagttaataagagaaagtctattgaattatatataggtctagtagcaggtcatatacaatttgtattatcgattttctcacataaaagaactctagaacaatggttctcaaattgtttagtttcagaattcctttacagtctaaaaacttgaggaccacagggaacttttatttatgtgggttggctataactcattactgtttattagctataacctaatatttaccatataaaaattaaaatgggacatttaaaaatattaattcatttaataaatattaataaaaatgccttagatgtaaacataaataacagtcatatttccaaattataacaattatatttttcaaaacaaaaacaatcactggcattttctcaaatttgtgtgaatttctttaatgtatgccttaatgaaagacagctagattcctttatttgcttcagtctgttgtaatatttgttttggttgaagcatatggagaaaatacaaccttacatagatatgtagttagaagagagagtattttaataaccttaaagataattgtggatattcttccttgataatgcattaaaactcaaccagtggtagtatattttttaatctacttttttttttttttttgagacagggtttcactttgttgcccaggctggagtgcagtggtatgatcgtggctcactgtaacttcgatcacccatgctcaagccatcctcctacctcagcatccctagtaactgggaccacagagacatgccaccatgcccagctaattttttttttttgtagtgacagagtcttactctcttgctcagtctagtcttgaactcctgggctcaagtgattctcctgcctcctcccaaagtgctagaattatgggggtaagccactgcatctggcctatccacattattgactgaatttgttaaacagctttgttgaaatacaattcacacatcatacaatgtgcacatttaaaatgtacagctgtatgacctttattatattcaaagttatttagtcatcaccacaattttggaataattttaacaacacattcaattttataatttttttcacaccaaaaagaaacctcataactacccccaatttccccatctcctccactgctaggcaaccactaacataccttgtttctctatctatttgcctattctgggcatttgatgtaaatggggtcatataatatgtggtcctttgtggctggcttcattcacctagtgtaatgtctatattattcctctacgttttagcctgtatcagtatttacttttattgttgagtaatattttattgtatagatatataccataggtgttttttaaaaatatatatatatttattaggtgatggacttttgggttgtttccaccttttggctattatgaatagagttgctatgaacattcatgtgcatgtttttgtgtagacatgtgatttcatttgccgtaggaatatacttagaaataaaattgctagatcacatgggaagtccttgtttaaccatggtagtttcttaaaggttagttgcaaagtgaaatcggaaaccatgacaacagacttttcttattctgttatgttatagttcattggtttctcttgacttagaatgaatctttcacccatgcacgattttgtaacattatatattagtcataatagtcatttggaaaatatttgtttagttagttatgcagatcttccaaaagtttatacattttattacacaatatcaaaattcacattggttaatattaccactgatttcatcagaaaaacctaaatattgggaattttatcaggttcataatgactcattttagttttcaaaaatgctaatttttgcttaaaagcttaaattttatcattggcaacaaacgctatctatagttttccttgaagtaacaggcccgctttgttcattgtagagaaaatgtttgtgaagtacccaatttggaggaactgtagttttgtcagttcctcaaacaaaaatgcttttccataaagaaatcagttagtacagcttgcagtttagttgcacatctgcttttccttgaggctatcattttgtggtatgcagcaaaaatgtcttatgtgtacttcctatttcattgaactgaatattaaaaagatgtttattaatgggtcaggatttaataagatgaataatttttgctgtttcattaagaacatccttaaatgaaacttacttagtttgcttcttaccgcaagtgtatggtcagaaggattcagcaagaaatagctgttttcatgctactgcctggattcatgctaaggcactcagtattgctcttgcaccatcagtgcacatgtcaacagggtgaaaaacacaagcagtgccttagaattattatgaaattagttttgatgttaaacggtccttaatagggtctctgggacctcgggggatctgtggaccatgctttcacaaatgctcctctcacacacccaactttctgtccctgtttctttttttctaaaactaatatttccagaaatgttaagattaatggaaagtcatttgtcattttgagtagaaacaaatatatttttgttatcttggaatatgctgttgttttgatcatatttctcctgtttaattcctcaaggatctagaaccagaaataccatttgacccaccaatcccattactgggcaaatacccaaaggattataaatcatcctactataaagacacatgcacacatatgttcattgcagcactattcacaatagcaaagacttggaaccaacccaaatgcccatcaatgatagacctgataaagaaaacgtggcacatgtacaccatggaatactacgcagtcataaaaaatgagttcatgtcctttgcggggacatggatgaagctggaaaccatcattctcagcaaactaacacaggaacagaaaaccagacactgcatgttctcagtcataagtgggagttgaacaatgagaacacatggactcggggaggggaacatcacacaccagggcctgtcagggggtggggggctaggggagggatagcattaggagaaatacctaatgtagatgatgggttgatgggtgcagcaaaccaccatgtcacatgtatacctatataacaaacctgcacgttctgcacatgtatcccagaacttaaagtataataaaaaaaagtttcatgatctaaagaaattcagaaaataaacaatattaaaatgaggaaacattggaaattagttttttacttatttgcctaatattgagtagtgaattttcttattctaatctggaaaccaagacttttatcagctattttactagaaaatctatgtgagatattgtaacttagaaaaagtccaaagcaaggcttaatttgtctgtcatattgaataatcttcaaataatcttttagtcttcaaaaatggttatagaaaaactgttagatttgagaaattggatatgaattatgctgacattctaacattctcaagttaaattcccctaagcagtgttttatgggaaatgaattcatttgaacaacttaaagaaatattttaagaatgagatgtgcctttagttataaaacctcttactgctgcaaacatatgtaagaattttgcagtaggttgaatgaattagctatataaaagtctgcaagtaaacttccttcctatagaaaatataatagacaggaaataaattaagtagagatatttagctggttgaaatcagattcatttttgtcagtgctttatttgtgatatatttttgataggaattttcagaagacttaaagtacatatttatacttttgtactttaaaataatcacattattaatagtgatgaaaatagcaatagataatacttattgactgcttgccaagtactacctgttttttttatatgcattatctcattatctcatttaattctcaaatagctaaatgaggactgttcttaccgggaacaaataaaccaaaaaacatacaaacaaaaaaaaactcaaagctttggatgtggcaatcattgacatacttatttgttatgggagtaatttcactaccctaaaacagcatttttacactctaagcagtcttctgtttgataacaaggattgttttgtggtagatgttttgctttttgctctcttttaacactagtaaaatagactggaaagtcttttagcctttctataaactttaaaacattgttttctttccagaaatactgttctgatagactgggtttgattgaatttttctgtaaagaaatacagataaaggataagatgtgatatctaaaaattttaggactctgaggactaaaaatgataaagatgaaaatgatgacatttattgtatacttattattagctaagtatggtaaatactgagtattagccctctctataactccatgaaatataggtactattcttattcccacttttcaaaagggggaactgagacacagaaaattttaagttattttccaaaggtcctgttattggtaagtgatacagccatgatttcaacccagattttatgtctaaagtacggctgtgtttctgccattagactagcaatctggattcctaatcctggctttagagactgtgttcttgtgcaactttcctaaactctttaaacttcactctcctcatctatcaaatgagaataagagtagcagtgcttaacgttatgagcatcacagatccctgtggggtgtgttgtgagaataaaaaagaaagtaaaagtattcagcacaattcttggtacacaaaagtactcagtaaatggaaatatctatggtggtgaaataaagtctctcttattgagtgtatttccagccatgtggtccttactactatgccacaatactaaatattctgctgacttcctgccttctattttaagccagtctaatatacacagcagccagagtaattatcctaaggtttatttagggtcatttcagtcctttcttcaaaaaccttcattgcttccctttgcctgctgaactaaataagaactcagcctgctactgaagcctccaatttatctttcttgctttattctttctcacagaaacctgtgtagttctcatttggagtgggaatacagttgtttggaaatgttttagaacgtcagcattactaaaggtctacactcagcatttagaggattaggaccagggacactccatattattctgtgagtgtgacaatctcagacatgaatagtctcagacaaatgtggatagtcaactttttccacttcctactctgacccccctccctattttcctactatcattcctttactcctgctatctatttgactatttctatctctctttctaattctgtggcagctgtcatcttatctagccttcaaggccaagcttaaatgatcatttgtatttctggattcctccagtttctatgtgaaaccacccttgtatcttttttaaaaaaatcttagatagctttaccctttatacttgtttataattataattatttttcatgaagaagacaattgactaccatgaaatcttttttaaagacaagttcaaagtctgattcatctttagtgtctcaaaatgtgactatgttgttataccttttaggtctttctggagggtagacagcctgttttacattctttgggcataaatactctgccttatgtatctcagcattgctgatgcctcacatagtaccaggccagtgaccaatgataaattcttgttttctaaatcaattcctgtaagtagactgaaagtttcttgaaggcagttaaaacaatatttattatttggtggttcacctatcaacattcttatttgcccatctatccattcacctgtcccttacttcattcagaaagactatgaaagagctggcaagagcagcgactatacttccctgtgtatatgaaacaatagatagcacgatttcttttatttactaggtgcttaatatgttttgttgtgtggacttgttagtagcctggagcataaaggaaaggtgaaaatgttttcatttcttctgttgttcagtggtaaattaccataaatgtcaaagcacccgggacctgaatgacaggttatagaaatgtaaaattggataaatatggtttcttttaacgtggtgacatgctatcaacaatatatatactctgaacagaccatttaaaaatagaagaagaagaagaagtcttgctatgttacccaggctgcagtacagtgactattcataggcgcagtcccattactgctcagcacaggagttttgacctgctccatttccaacctgggctggtcactccctccttaggcaacctgttggtctcctgattccaggaggtcaccatattgatgctgaacttagtgtagacacccaactggcatagtgcactacagcccagaactcctgggctcaagccatcctcctgccttagcttcccaagtacctagactacagacgcacaccataggaacctcttagtacttgtctagtttatacccctcagttaaataaacaataagaaattaaatgacaaattcaagggcaaacacagatttacattcagagattactggcagattatgtaggctactgtgatttcactagagaaaaataactccctaaaatagtttttattttaaattttatacacacacacacacacacacatatatatatatatgtatttttgagatggagtttcgctcttgttgcacaggctggagtgcaatggcgcagtctcagctcaccacaacctccgcctcccgggttcaagcgattctcctgcctcagactcccaagtagctgggattacaggcatatgccaccacacccggctaattttgtatttttaagagagatggggtttctgcatgtttggtcaggctggtctcgaatgcccaacctcaagtgatccgcccacctcggcctcccaaagtgctgggattacaggcctgagccactgcgcctggcctaaattacaattattttaaaagtgtttcagtataagaaggaagtctaggattattttaacctgagtatttcatgggatttaggcttaatccgggtcatttagaaatagtcctacgttatttaatgatttaaaacagaactttatgctttcattatttggattaaataaacttctattattttttcttatcctgaagcaataatctagagaaaaaagcagatgcctttaccaagtttcatgttaaaaaatttacttgccagccagatgcggtggctcacgcctgtaatcccagcactttgggagcctaaggcaggtgggtcacctgaggttgggagttcgagaccagcctgaccaacatggagaaaccccgtctctactaaaaatacacaattagccaggcgtggcggcacatgcctgtaatcccagctacttgggaggctgaggctggagaatcacttgaacccaggaggcggaggctgcggtgagccgagattgcgccattgcactccagcctggggaacaacagtgaaactccgtctcaaaaaaaaaaaaaaaaaaaaaaaatttacttgccaaaataagtaccaggaagttttcatgtcttctaaaatttgcctttgtttcaatgtaataattactcatgtgttattattataagtaatattattagccgtcttctaaatgaggtagtacagtatagtgcaaaaaccatagaatggtcagaaaagctgttttctaatcctggcgctaccacttactggctttgaaagacagcaaattctgtgattcctctgagcctgtttcccagtctataaatttgggatagtactccttaatccttaatcttattgtgaggccttgctgaaattatgctcattgaaaacaaacacttaagcttggcatttagtagacactcctcaaaagttgtagtagttatcactgctagaatctgctaccatagattaatttgtaagtttttaaaaactctttattcccttgataaggaaaagtgtatgcttaaatatgttttggcagtttataatggatcactgtctagatttcttttggattctccattaatctgaactaaaaatcagataaatttctgtaaaatttgttttgccacacctgatggaatcatggtcaagtcactttacctctctgggcctgtttcctgctggcaaggggagttgtgacgtgtgaatgttaaagcccctttcagttcgagaattcagtgattatttttggaatattattattataatgattcattctaaaagtccaactttctttcaaacgtttattgtctttttttatgcgatgctagtatatatgtatattataggcaatatatacatagacataaatatatatatgtaggtaggtgttttctaaacctagtctatgatgataatcatcaggagtgctcattaaaatgagttaaaaatctcctctacagattcagtaggtctggagaaggccccaggaatttgtagtttgatgagcataccacatgattattattatcaccaagtttaaaactgctgtattcttttactctgttttagctaaaaattaatttggactttaccattttggcagggagagggagaagaagagcctatatcttgagatgctgaggtccagtctctggacatttatttcatgcaacaaatatttattgtatgtttactatgccagataataaaggaatttactacctagatggataattttttaaaaaaaatctcacgagataatgagtaatagatgtataaagaaaggactgaagagcagagagaaggaaatgatcagttctgcctataggggtgaaggagaggtatctcaagacgtttaagaggaagtaacacttagggtgaactttgaaagataaataggcatttcaccagcagaaaatatggagaaagggaaatgatgttaacaagaaagtataagaatgccagatatggccgggcgcagtggctcatgcctgtaatcccagcactttgggaggcagaggtgggcagatcacgaggtcaggagattgagaccatcctggccaacatggtgaaaccccgtctctactaaaaatacaaaattagctggacgtggtggcgggtgcctgtaatcccagctactcaggagtctgaggcaggggaatcacttgaacccgggaggccgaagttgcggtgagccgagattgcaccagaaatcctgtctgtaaataaatacaccagatataaatctgtctctagacaaaagaatgaagaaaactgggaataataactataaaggactttttcccccacattacaaaaatgtatttgaaataattgactgaagtgacaataatatattgggggttaataacatatatgaaagcaaaatgtctgacaatagtacaaaagctgagtgaggagaaacggagatgtatagttgtaaggttcttagactatatgtaaagtggtagcatattacatgaaggcagattataagttaaattttaaaaatatcagcacagatacacatatacacaaaaattgaaaagtcataagatttgacaattcagatgagtaaatttgggagctaagaattgcatctctcctgtacctcaaaaataatttctcacatagatgatctattttaagcctaaaaatgaaggttgattgtgtgaaacatatgcaaataatattactttgaaatagtaaaacctaggttttgggttatttgtttggggtttttttgtttgtttgtattttgtttgtttttgagacggagacaggctctgtcgcccaggctacagtgcagtggttccatcttggctcactgcaacctctgtctcccgggttcaagcaattctcctgcctcaggttcctagtagctgggatatgggcacgcatcaccacgcccagcaaatttctgtatttttagtagagatggggtttcaccaggttggccaggctggtctcgaactcctgacctcgggtgatccactctcctctgcctcccaaattgctgagactacaggcgtgagccaccacacctagctgtttttgtttttctgttgtttgtttgttttttgttttaacacataacttgctttggacagaattaagtgtaactcctgtaaggaacaagaaaacaatataagcctatacttacacatccattacactgaaagatttctaaacaatttttccaccctaatttatgctaggctttgttgttttaagatggcaaagtgtataaatggtgccagtccctgctcaggcaaaattttgaagtagaagaaatgtgttgtccattccctgtccactcctctttgtattggttatcaacctcatacccagcccttgcagctcactcatgatctctcagctgttaatttttttttctgatactctgttcccagaaaaatgtacccatcttggtaagcagtactttcctttctattgtgataaatattaacaatgacataacctcatggagaactgcagtttgctccgtcagtaccatgctccaaacaactgggaagggtgagagaaaaagggcaaatgatgtacttttcctctgtgtgatattgtgacaattttctagcatgtttcttatataatagtgactgataaaaagccttgataccagtaagcagtagcaaatgtactattaatgtatttcctttataataattcttcatgtgtatatttcaaaaaaaaaaaaaaaaaaattctgtcaattgtttctcagagcaatcccaggagttttcaggtttagaaaccgaatcacagaaagttgaaatgacaaaggtaatcaagtaaagcctgaactagaacctaggtctgctgaatcctagttaattgcattctcaaaagcacaaggaaaaatactggaattgagtgacaaagtggttgtctgcatgtttgggactgctggcaagaactcatctagactttttacagcttgaatagaattcattactatatgatctttgatggaaatgttagaattgttcacaagggaaagtctaaaaattctgtccgtgagcaacctcagaaaactgccgatgctgctaaacttaactctgagaatggaattccacagattatctggtattttctgcagcctgcccaactcaataaacccttcattcgcctctgaatataatcctttgacctcgttctcttttagttatttgttttttcattaaagtgttattcttttagtggcttttttaatcagctttgatgcctatggctacaaataacagaaaacctagagtattgtacaggaaggaaatgtctcagctctcttagctcttgtaaaacccagaggtgactccagaatgatctcagtcgaatacagcttcttttctcctaactctctctgctctgctgtccttgatatgttggtttcatcctaggctgctttcctcatggtggtgttatggctataatagttcctatgtacatgtctgcacttcacggtggccaagttgtttcccaaagctaccttataagcatgaggaagcttccttcccagaagccttgagaaaacctcttcccatgttttattagaccaaattatatctcatgccattcctgaaccaagccctgtgatttaagcagtgccatatctgaatggcttaggcttgagtttctgaaccaaaggaaaggaagatcacccttagacccattccacccctggatcctggaggttgctgtgtatttccctgagacacatgggctgggagaagggggtgctgtgaaaaattagatttctcttaggataggggaaagtggaatgtatggtgagtaggtaatgattaatgtctgcatcaattgtcttgttttttcctcatctggcttttagaatcatgtagaatagttaaaatagtgtaaattttgatgtaagactagcttttagagacctcttctggcacttggccaggttccttaactgctcttctatgcctcagtttccccacaattttataatgattaaaaataatgtagtctggccaggtatgggagtttgcatctgcaatcccagtactttggtaggccaagacaggaggattgcttaagttccggagtttgagaccagcctgggcaatatagtgaaaccttgtctctacaaaaaatttaaaaattaccgggtgtggtggtggatgcctatagtcttagctactttggaggctgaggtggaagaatcacttgagcttgggaagtggaggttgtatgcagtgtgctgagattgtgccactaaactccagcctgggtgacagagcaagaccctgtctcaaaatgatgatgataataataataataataataataataataatgtaggcaaggaacttagcacatagtatatatttcaataagtaaatatagctgttattaatggtttttttttacttttgaaattataaacaataagtgaaagttcctttttctcctgctgaggcctgtgctatccccaaatagttattattaaaattagtagacaagaaactgttcattagagaatgtaggtaggatgcttaccataaaattctttcaagtttttctgtgtttgaaaattttcgtgatgacattgaaaaaaataagtttacaagaatgatagtgttgcaataaaaaccactgagggtgactcaagagaactagaaaccaaaattcttcttaagacagcagtaagtttaacccagttcaggtgaattgctggaatgatgttttcctcttatgtcccaagcattccatttctttatgaggaaatacgcagtctaaaatactgggtttcctgcattgaaactccttggccttaacttttgtgtgggcagcctacagcaccaaagtataatgaaatatgtatgagatctcactaaaagagctctggagttagccactgagaaataaagggtgggagggaaagctgtgcatagaaggagaaccaggaaaatgacctttattgagttcccattatgtatgtgccaaaggctctgtggttataaggataaataaaatactttcccaacctcaagagagctcacaccttagatcagaagacacccctctcagtaaataattatggcatatgataagaagtgccatgtgtcagctgggtacagtggcttacacctgtaatcccagcactttgggaggctgaggcaggtggatcacctgaggtcaggagtttgagaccagcctggctaacctagtgaaaccctgtctctactaaaaaaaaaaaatatacaaaatacaaaattagccatgtgtggtggtatgcacctgtaatcccactacttaggaggctcaggcaggagattcgcttgaacctgggaggcggagtttgcagtgaactgagactgtgctgctgcactccagcctgggcatcaaaagcaaaactccatctcaaaaaaaaaaaaaaaaaaaaaaaagtgccatgtgtctgagagcatactggagaaagaaaaactagaggatcttcataaatcttgcagactcctttagttagggttaggaagaagttgttaaagattgagattatttcccacagaattttgttgttggtttaagagcacaagtcactgttctgctgctgacttactaagatttaacaggaaacttagactccaccttttgcctttgtcagcaaaatcccccagtctctctgtatatggagatataattgagaaagattacttgcattcccttctcttctccataaataaggatgaagggctatcaaggtcagaccaaaatttttacaaagtaaattgacaatagttaggacaagatcttgatattaatccccattgccgtctcttttccctcccctgctatatataatcttcttgtccccagcaggttatctgttaagagtctgctctgttttgaccctagcactttggaatcagcccagttgacttttttataacatgtaatatagcccactcttcactgcttaattgctttatcatgctaactcctattactttaccagggcctttttcccctttcattttagtgattgtcttgttgcagaattcgctataacagaatctgacttatgtaagataagttatttttgtaacccttgtctagaaagctcttagaaaggcatgggcagaaagactgaagaaaccccaagaaaacttatcaggagttttttgctagtttgagattcctcaaaagactcttatctacattcattcctttttttgtttgtttgttttttgttttgtttcttttttttttttttttttttttttgagacagagtctcgctctgtcacccagcacccaggctgcagtgcagtagcacaatctcgactcactgcaacctccgcctcccaggttcaagcgattctcctgtctcacgctcccgagtagctgggactacaggcactcaccaccacgccgggcttttttgtatttttagtagagacggggtttcaccatgttggtcaggctggtctcaaacattcattccattttgtaagatggtaggatatatcaatgaatgaatgagcaaaacaattaaaaagtcttgtgcaaattttttgcaaggctagagacaagattagtagctgctaacattggtatagctctttacaatccatgaaattttttcacttacatcatttaatgtaatctcacaccatccctgtaaagtaggtattttctccagtttatgttgtcagtgagatctgcagagattacggtcccataacagggaagtggaagagccaaggtttcgcctccaggtcttctgacactgattacagagatattttattcttgaatctaggggacaagaagttatgagcatatttctttttggtaagtggaaagcaagcaggaattttccttaatgcttaattagtagactagaatttccaactaccccagtgagagaagtagtatcctgtaatggatacaaggtattttatatgagatatgcaacacaattttagattgcctaaaaaacaaaagggcacagattgatttttaatctacagataattttataatgaggagaattaactgaaattttattgcaaagattatggcagttcactgtatgcagttagcatgttcagaatggaactcctgatttttccctttctccaatcctaccgcatccatagtctttctcatattagtcatatacaacacccttttccagttgctaaggccaaatatgagtttatactcacctcctgtttctttcttagacgttgtatctaatctgtcaggagatcttcttggctctaacttcaaaatatatccagaatttgacttcttatcactaccttcactgtttgtctctcttccaagttaccatcatctctcacctagattactaaggtagcctcataattcatctcctttttgtaccctattctcaacacagcagccagagtgatccttttaaaacctaagtcaagtgagtctcttgtcccctcaaaagctttcttcaaggagtcctgcttcttttagagaaaagccagtgttgacaatgatggctttcaaggccctatgagatctaacccctccatcagtctctgacctcctcttctactatgctgtccatcacactgacctccttgctgttccttgagcatgtcttttgtgattcctgccaccagacctttgcaaaggtgctttcccagcagcttgagtctttactcaatgtctcctccttgatgaggcctaccatgacttccctatttaaaactacagtcttcctgtagaacccttcctgatctcctttactctgctcttgtctttctcataccatgtataatctactaacatactgcatattatttacttatttgtgacatttccctacctcctcgtaatataggctccacaaggagagtttttttgttgttgttgttgttttttgtttttactggtatctacccagtgccttaaattactgggcacatagtaggggctcactactaatttgttgaataagtaaatgatggatataattaatgaatcaccgcaaagaagttacagttttattgaggaggtaatattatgctgcttctggtagcagttgaccaatacagagccttatgtggtaaaactacagatagaagtggtagaagtgggagataattgaagccactggaaagggtatattcaatcacttcttggccttttggctgagatcaagtgtagggaaaatgaaagtttcactggctttggtaggttagtttgccagcattgcttatatactttccctcagctttttgaaaatcagatactctccacatgcagagataatggtactcatttatcatcataagaacatgcacttgttcttttgcaatagtaatgtgaaaggggctcacatttgcaaggttgttagagttaaaggtaaaggctatgtctatgaaacatacatatatatatatatttttttttttttttttttttttttctgtgtgaacccaatttaactgacccaatagcaaatgaactaacttgcctagataattcattatgtgggtagatgggatacagagattggaaaatgtcattggtgggttatgtatgtcagttggtagccagtataggtttgattttttctgatgctctggccagcccagttcttttggtttaaagtaccattttttcttttgatgtagtaagaacatttttctgtataaaatagtccattccttggaatggaaatggcattagatctttgtaacttaggtagtttttagcactggattgtttagtttgtaaaaatatttgatttagactgagcttgtggcctgatgatgtttagaagagcgccaaagtgtaactcatagaagatgccagtaaaaaccatagttggaagaggtgaataatggttgcatcattttcctggtaggtgtagccaggcctaaaaatccatccctgctatttataaaatgtgttcctaaggataaagtcagctgctatattgtgaactacattatcaaaataaaatatatgccagtgccttgagtcactgtcccactgtctttacagtgttaaggaagctatatttcatcattgtgttttattgcagtaatatttacccccacttttaatgaacatttttgttccagtgaaaaccttgaacataccaggtttttcattgtgatttaactctttcttttctaccattctgactgcaagtgtctctttgaactgatatttgtgttgtccttgtccttattttgcttttttttttttttttcccccttcctgagatggagttttgctcttgttgcccaggctggggtgcaatggcacaatctcagctcaccacaacgtccgcctcccaggttcaagtgattctcctgcctcagcctcccgagtagctgggattacaagcatgcgccaccatgcccggctaatttttgtttgtttgttttttagtagagacggagtttctccatgttggtcaggctggtctcgaactcccaacctcaggtgatccacccgcctcagcctcccaaagtgctgggattaaagcctgagaacacacaaacagaaaaggctgggaggaagttagatataacatgcaggaggtccacagttttagaccagaacttctgctagggtaactatgtatattatcatctaaacaggaaaatttttagaataaaataaattattactaagtaagtcaagacaatactcatgaaataggattgtttcaggccatccaagacatgtggtcatttatttaaaagtgggatgggtgggaaactgctatttacttaacctcaaactcttcactttcccaaaggcctttgtaaaatatcaaagggggatagaaaagcagtggagaaaatttaaaaaaatttcatccttcaaaaagatcagcaaccaagcactttgagaggctgaggtgggaggattacgtgagtccaggagttcaagaccagcctgggtaacatagtgagaacctgtttcctatatgttaataataataaacaatagaccaggcacaatggctcacacctgtaatcctaacactttgggaagctgaggcgggcgatcacataagcctaaaagttcaagaccagcctggacaacataatgaaaccctgtctctacaaaaaattagcgaagtatagtggcacacgcctatagtcgcagctacctgggaggctgaggtgggaggatcacctgagcccaggaagccgaggctgcagtgagctatggtcacgccactgtactccagcctgggcaataaaataagttccttaaaacaacaataacaacaacaacaacaaaaaaaacccagcaacattgacaactcttagctagtctgtttatgaaaaagaagactacagtactaaaatctggaatgaaagaggtgacagtaatactgactttacagaaataaacagaattagaggaaaccacataccgtatgcaaaaattaacacaaaatgaatcagacctaaatgtaagaactaaaattataaaactcttagaagaaaacataggagtaattttttgtgatcttagatgaaatgaaaacatatgtccaacacaataacttgtacatgtgatagcaacattatttgtagtagctaaaaggcagaagcaacctgtatccatcaactaatgaatagataaataaaagtgtagtgcaccatgcagtagaatattacttgaccacaaaaaagcaataaggtacatgttataacatggatgagccctgtaaacattgtacaaagggaaagaagctagtcattaaagactatatactatatggctgcatttatttgaattgtctacaataagcaaggccatagagacaaaaagtagatttctggttacctcagggtcacaggaagtaggggaggtggagtagtaggggaagtgcctgctaatgggtatggggtttctttggaaggggtgataaaatgttctaaaattgattgtagtgatggttgtataactctaaatatacaaaaagcacatttatatatccactttaagtagatgaattattatctcaaagcatatattgaaaaattatatcaagggtaacaagtttgcgaggatgcggagaaaaaggaactcttatgcgttgttggtgggaatgtaaatgcatccagccattatggaaaaaagtatggaagttcctaaaataaactaaaaatagaactatcatgtgatccatttctgagtatatacccaaaggaactgaaatcaatatgccaaagaaatatctgcactcccatattcattgctgcattattcacaatagctaggagtcaacctaagtgtttatcaacagatgaatggataaagaaaatgtggtatatgtcaacaatggaatactattcagccttaaaaaggggaaaattctgtcttttgtgataacatggatgaatcttgaggacattatgctaagtgaaataagtcaggcacagacaaatactgctcgatctcacatgtgaaatctaaaaaagttgaactcacagaagtagaaagtagaatgattgattaccccaggctagagggtaggggaaaggaggggatggggagttgttgatcaaagagtacagactttcagatagacaagaggcataagttttgagaatctattggataacagggtgactgtggtcaataataatgtattatatatttcaaaataactaagagactaaatttcaaatgtatcaccataaaaaaataggtactccagcctgggcaacagagccagaccctgtctcaaaaaaaagataaataagcaagatgataagatggtggatatgttaattagcttgatttaatcatgccacattttattttatttttattttatttatttatttatttgaggtggaatctcgctctgtctcccaggctagagggcagtggtgcaatctcagctcactgcaacctccacctcccaagtagctgagattacaggggcacaccaccacgcccagctaatttttgtatttttggtagagatggggtttcaccatgttggccaggctggccttgaactcctgacctcatgtgatctgcctgcctcagcctccccaagtgctgggattacaggtgtgagccaccatgcctgacctaattatgccacattttgtacaaatatcaaaacgtcacactgtacctcataaatgtatatagttatgatttgtcaatcaaaaataatactaatttaaaaattacatcaaggggcagttgacctgtagcatgggctgtgttgccctcaaattacatgcacacatatgcattatacagttgttctgtggcaactttgcttttatatgttttacagattgtgcatcccctctctcctacgcacccctcaaccactgttccattaacccataagacgttctttgaagaaagtgtactgtggcagaaaagtagtttgaaaatctctggaaacaatgagatccagaacctcctccagctctaacaagtcatgattctgatgcattgaatttagaatatgaacttggcctagattactccattttaactccgtgtcgactaaaggaaagctgtgaacaaagtcagttttttcccacatagctgcacacaggtgtgacttagtggaaactgtggaactcagccagatctttagctccctagtgcagtgctctatctccaagccctacttcctgttcttgaattcagtgatttgctaaaatagagacacctggttccagcaccttgcaaatggatttttcctttcagcattttaaagtacattcatgtattgatgaagagctttctctggaaagccatctgtctgaaatctgcaggaaaaaaaaaatctccctagctgtcttagatattcataatggtatgtgttgcttcactcctctactcctgcctcctgttcccttttcctcatgttttcattcattttacaaaacaaatatttatgaagcacctagtatgtgcccaacactacatatgtagcagtggacaagactaattagtccctacaattaaggatattgccatctagtaaggaaacatgtggacaaccacaacaacaaaaactttaaagatttttgagtcatggttaagagctatgaaagaaataaggttccgagacaaactatgtaggatgtgattttaaaatgaactccagagttatattgccagtgttcaaattccagtttcaccatttactagctatgtgtttttttttttttaagggggcagacaggatctcgctttgtcacctaggctggagtgcagtggcgtgatcatggttcactgcaaccttagactcctaagctcaagctatcctcccaagtagctgggattacaagcatgcatctccatgccagctaattttttttattttttgtagtgacgggatcatgctatgttgtacaggctgatctcaaactcctggctcaggaagtcctcccatgtcagcctcccaaagatctggtattataggcatgagccactatgcccagcctagctgtatgattttgagcaagttgcttaacttctctgggcctcaatctttttgccttaaaatggggataataatagaaacttctttagtagagttgttctgaggattaaatgagttgatgtacatggtgcacatagaaaagttcctggagcatactgtgcatccagtaagtgttacctatatgttggcattgttgctttaaagaatatcagggaatcaactaattaggttagcattgttatcatcttaatcaccatcatcattgccatctacagatacttatcttgccacatttatgtgcattgtgcccaagatttacagaagtggatataacatgctcttggactcaagaagcttacaatatagagtgtaaggattaaaagaaaattgcagtatatatactaagtgctagataagtgatagagacagcttgttctacagcattgtagggaagagagcagttattgtgggctcataaagagaaggcctctcggaggaaaatggactcttatgagggagagcattctaggctgaaagaacagcacaagtgaggatttggacataggaaggtgaatgtgaagttccagaatggagactttgaatagaggagcagtgaggtgtgggttaaagaggaggccccagcattctggttaaaattatttagtaaacagtaatctgccatgtccagattctgaggtggagtaatcaaataagatttctctaattcacctgaggcctactagtttacatattgccttatttcaggttcccataattgtcatctagttgattgctttccaactggtgttgctacctgcagtctctagtcacctactcccctctgcacatttttatcgcattaatttttctcaaacatccttttgtcactgacttgcttgaaaagttcttagagttctccattgtgcatagcggtgtttctgaaacattaacgtgcataagaattactgggagttcattgtaggtgcagatcactaagtcccaccttcaggtcacatgcttatgacatggtgcctgagaatctctatttaaacaagtgccctaaatgattctgattcaggtgctcaagagtcactgctttgaagacaggcctaaaatgaggagtgcaagtctcttaacctgccacccagagtcttgctttatcctgccttttcaaccacatcttctgttgttctgattaataaaccttttatttgagccaaatgggacattttcttttccatacacttactttttccttacagttatgctcttttttcatcttttgtgtcttttttgtgtgtttccctaagcctcattgtctctactgccatttcaacaagtccaaatcctggcttctttctgtcctggtttaggtatgtccagaaagcatctttagtaaatgagtacatctctaacctagaaggtaggctccaattttaactcatccttttatctactcccctacccaggaatctaatgagcaccttgcaaatgattcccttcatttgtccctccctccctccctccctccttctttccttccttccttccgtaaagatttactgagcacctactgcttaccaatgaactgttctaggtgctaggtgataatgtaggggaaaaaaaaccctctcaaattctgttttcatggaccttacattctcattgggcaactgtttataagtaaatattgaaagtgttctgagagtaatctggcagtgctatatgggatatattaggaatgggagagacctgtgaaagaaattaactaaggaactcttgcaagtggcctttagacagtggaaagggtcagtgagaaagtaaaaaggaaacagcaagagtaattagtgaaatgaaggaatgaccaatagtatttgatgggggccacaaaagtttatttaatagttgagcttttgagaagaaaaaaatgtaaaatggataggtgatgtttttggtaaaagacattaaaaatgttatgatgcattagatatgttgtttatgatgttgataatggggcatccaaatgcttagtagcaattagaaatacagaggtattataagaggccaggcctctctctccttttccccttctccaatttatctcaaaaatcttatgtctgtcttgttgttccaggtccaaaatttcttcccaagaatttgtgtctcattcaattggtttttctgggaatcatggcatgacttcatgtcttagccccatttctctgattgccaaatgtttgtctataaagaggactaggtccaaccctagaacattgtctctaatcatagccttcctttgaatggttctcggctgattaatggtttggcttgtgggaggaactaggaagacaacataattgaactagagattcctttaaaattgggtacagtcgtgagtgtcatgcccctatgggaatatcactgtggtcatttatgattcttagcaaaataggcaaagtttggaaaagcaaattgtaaaagctttggcataacacatagacaggttggaaagctgcttgtaatcatctggaaaatcatttttttccattcttgcagttgctctgactaaaaaaaactcaaattgttcctgactcctgtctttctctcataatactaaacatccagtctatcagcaaatatggtgtgtgtgtgggtgtgtgttttatatatacatatatatattttattggctggcttccccctagaacgtaaacttcatgaaggtaaaagcttggtttttttatatccttagctagtgcctagaacatagtagatgctcaatagcaatttgatgaatgaatgaatgatgtgaaattaaattttatttcacattttgctaattagttttgacattagctctatcttcaagaagcttgggaaatattttatcccaataaattattctagctaaagcccagcagcacaatattatttggtaatattattaaccaaataatattatcttagtgtaagaaaaagtagaaactttatttcttaactagagaaatgtcagaaagttttgaagtctaagaacactctttaatggtgctaatttggtaatagtgttgtgaatgtgatattctaaaatttagccttaaaagacatcctaataagatcagctggtaatcatacaccaggtatgattaaaatttactttttaattcatagtttttaaagaaagttttcttagcagtttggagactggattactactttaatgtttgaaaagatgatgcttgatatttgagaggaagaatgtcttctttttaacctttaaactttattcaagcagttccatatgaccaaaaatatccaagcttaatgtatacattagattaccttcattaatatacagaaagttgctttcttagaacagcaagaatgacttgtgacatatcagcatattaaaatttactggtgctatggggctagctgaccagagatattgttaggaatttttacctgatttagagaatactttgaatttccaaggattgaaggaagaggttatgatcaaagcatttgtgtggaaggtcattttggtgtagtgattatttttatggagtagcagagaagaacaaagtatttgtaatggaaaagaagaattggctgcagggcataaacaaatatttctctctaacatcttagccattgcatttcaagtctgttgcatcattactttttaaggtattgataacatatgacagagagagaatatatggctttagttcagtttaaatatgatctatacaaagtaaagggtggctaatacaagtttgcaaatgactttccattctgttgggtcttgatggatttccataaaattagttaggtagtagagaatattgagacttgggtttactttgaagagaatctagcattaattacaccaggttttttaaattaaatagaataagtaataatgaaaatcaagtcaaatatttctatctggcaatgaaaaccagctactggatgaagttaattgcttgaccattgtcatcactttctcaacttgtactgaatattgggggtaaattagttttaaaagcatgtctttttcttgcttcatttccatgaatcctacataatttctttaaagggatatgtatgatttaggggataaagtaatcaaataaggatttgtatgtatttcatcaatagaaatttctccaagttcaactatagttttcttatcaaaaaattacattcacagttgcaaggcagaggcccactggaatagttaataagcacagtcgacttctatattgctgcagaaactaaatacaaacttttctgtgacttacatataggctcggtaaactttcatctgcttcagggtcagggctgattcaatcttaaagcaagtttatgagagtggctgatgtgatacagttgtttctggtaaaatcagactagctctaaggagccaatctaagtcagtctctgagtcaaattctatgaaaaacagactccaactcagacacaattgtaaaccctaatataatgaggacttgcagctgatttaatcctattgaaaatctttaagcagctatgggacaaaatggtttccacattgacatcagtggaatgaaccttggatttcatcagtctgaagagtagttaccctgtacacacagtagccactttgtaagaattaacatcatggccatttcaaagcaggttgttgtttcttatgtagaggcatctgttttgattaaggtccaagttgccagaatgtgtcaggtgtgtgtgtgtgtgtgtgtgtgtgtgtgtgtgcgtgttttaactgaattcattacaaaaagcaaacaagtcaaacttaaactcagagcctagtataaatcaattagatccagtctccttgaacaaaaatgaccaacctattcctattcactatatatgtgagcaacatagagaaagaacggaacagagaatgagaactgtttttgagttaaactatatgcaaagttttgcctggaactaattatttttttcatgaacttagaagtccctgaaaataagcttatgctgtgaaatcatatatgtataaagggacaaacacacacaaaagtctaaaggtcaacactgcagataaaatctcaacaggaaggttttgaacttacctatgtgcccatgttggtaggtggatacatatactttttttttagtttatcatattgaaataggcactgataatgatctaggtgttatagtcagtttagcactagtcttagttccttttcataatttacaacttaaattagaacaatagaccaaacacagactgcagtaaaacacaaccttgactgaactatctgcatgctgcttttattgcagttagcacttagcaggcagtagtggcctcatactgttacttcaaagagccggaaaagtaacttcatgaaagggaaaacttgaaactgtagtactctttatctttctgtctgttaagcagtgatgggtatcattagttctgctcttttgcataattactgcagtattgtgaaaaacatttttgccattcaactgggaacaattatattatttgagatcttgtatagcatttagttttagagaaataaaagataaaaagcccttgttttctagctctgggtatctgtagtaaggtagtgcatacagtgcttgttcaagtttgtttatttttttcattaaaaataacattaattggtgacactaaaggagacatttcatattgaagtcaattctttttgatgtgtttttgtttaatgtgcttgctaagataaatttcatctagcacatcactgagttgagatggtaattcattaataaaatgataaaggtttatgaaccataatatggacatcattgaaattttgagacttaaaaatatattcttattgttgtctagattaaattaatacaattttctatttatataaagcttccagtgtagattatctctgttaaaagcatgcgacagcctctcccaaccaccccaccctacctcatcccacaaacttctaaagcatagagctagaagtatgtttgcaaatgtttacacaatgaggtgcataactttttcaagtttgtaaaaattctcctttgtaatctcagtatgtgaaaccattaaaatactgtaactttttttactgtatttgttagataagatgttaactttttggaaaatactactacattatagcaagggcggtaaaattaggatgaagatcacagttatatatagatgtgattgtcactttgattctgtggttttacacttgactttttataatttataagatatgaaatataatctcataattggcaaaatatattttgatcaaggaaaaggtatgactgttgcctgttggaaatattacttcagcacggctattatattaccataattatgataggaagttagaagaaattttggatatgcatatgtttggtatatagtaagttttcttacaaagacaaaaagattaaaacacataattttaattaaaagcctggaatagatgctgaatttccttttcttgtcagccatcaaaacaaaaattgtatttgtttttgtccttaataattctcaaaaggttggtttccacaggtttttctttaaaattttaagcatccatttatttgcaacatttttattaatgagctgacatttgaatatgttcataaaaatgttgatatggctgaacaagaagtttcaatcaagcttccccaaaatgctactgaagaacatctaattaatataacccaaaattagtttaatgcattccttggtattgttgcattattcaaatgtggttttatttactactcctgagacactatgcctcttaaccaaactccagagtgagctggtaaacttacctatcttaatacattgaaaagaggaattagctacagttggttagctaccagtacggctttcagcaccttctccatggtggctagtatctgtaccgtatacagctgtgaaaggatgggaaaatgcgctgaaatgatctaagaagtaaactatcaacttgacatgttttcctagctattgaaaactgtctcatattgaaacccgttgatagtgaaactgtagaattccactgatttaagtaccatctggttgtgctcaaggctttaaagctgttatctctgcataaaatttcagagtcctatacttttttcttcaccaaactatccatttttaagccacaaatatttttccagctctctcagattttatctaaaagtatattttaacagcatttaaatagttcttaaacaataacaatttatcttgatagatggcatgctgtattttttcattttattttaattagccattgtggaactaaattcccttttgttttagtcttttgaatattaattatcattatcatgccagatatcttaaaggttattttaccaatacagttccatttaacataacccatatggaatcaatatcccagtttcctaaagtgaatgcttggaaaatcttacattcatatgttaagagtacacatcctttcctcattagttggaaagtacagggattttggcacaggttctgtgtggaagcattgtgcagcttttatatggattttgtttttagcctttgatgacactgtttagaataggaagtatctaataagtaaagcattttgtctcaagtgctgccagtgtgtttaatatatgcctggaggtctgaaacattatcttcttcgatacagtaatatgcatttaattctctgaaagcagaaggtcgaacttttgaaagggacgcaaagtacattttcaaacagaataattcaaaacatatggaacagaggaccgaagtaatgtacagttggtttttatggcttaatcatgatcatgttaatgcacaccagtagctaattaaagaaaacttttattgttcatcttaaataagttaggtaaagagtgggagagctgatgtaacagcactgcccagagatacatgtttctgctgcaccaacagcaagcagatactgctatttttgacaacttaaattattagtccccttggacaataataaagcacaagttactttcagagttattatattgtgaactcttcgttttccacaaaggaatagtaaattgatgcccaagtttagggcccagcacacataattaattataaaacttttcttaatagtggaccagatacccttcaatatagtaaatctgcagtggactggtgacaaaccagtggatttttaaatatgtctcaaaatcatcagcttgtttacttcagtgctacagatagtttagaggcttaaaaaaaatggaggaaatcctggcttttaacccagttttaggaatttagttttctagtactgggtaagttgtactttttcttttccttccaatgaaagccagagtctttcatctctaggtcattggttcaaattccattctgctcagtagtgattagaattagttaccatctgacttctgttcagtaacctttgtgacctgagctgatagctgccatcctgccactgctggttatttatagctcaagatcacaccacttgacatttgctggagactaatgtagcagtctcagcacataatataggctggatgctaaatttctttacctttctctacaggtggtttgttgttttatgttaacacctatgggaacacttaatccactttaaagagggagagagtagattttaagtataaatctgtaaatcagaagtaaaaaatgctctatgcatagaaactatagtttcatttagttaattgtggttgactttcctgagtcaaagaatgaaaatagcttataaagcttgagttcttgattggagtttgccatggaactcaacctaaaggattttttagttatactgtatttagatatttagtttgtaatgcctcaaaatatgcttgatttcacatttgactgcttaagtacttgatttcatcacttttcacatgttatgtgagaattcctagttggtaatatatttggaggtttatttgaaattttcataataaggataactaaaatgaaacttattttgataacaattatctttatcttactgaatttttaaatatgttcatacatttattcagtcagcacacaattattaagctttattatgtgataagcactatagtatgttctaggaaaactaacatgatgtttcctcttacccaaagcctgctagctgtctgaccttggaactattgatcaatctctataaaactcaattttctcagctgtaaaatggagatagtagtactcctcctcaaagaattataatgttagcttatgtaatgtgctaacagtgtctggcaaataataaacatactcagtggtattttattttttcttcaattgctcacaatccctgagacagaatatagtgtgaaaattgctataatattagtttgttataaaagcatagcagtgggaaggactagcaccacctggaagggttgctgaagtcttcacaaagaaggtgaattttttaacttaccctttttagagtgcctactgtgtttgttcaatatgttaattaattttatgctgcagcaaccctatgagttaggtattaatgtcccaatgtgaggacacagacggaagagataggattctttgaagtatgatcagcccacaaggtagagtatgcagatcaggaaagacactatgaatgactatgtctggggaagaccttaaggagtacagtattgagaattctccatttacatttctttatatcgtaacaatcatgtaactctagtctgctgggcaattttttcatttaatgttgtatcaaagataaacatatcaaacattcgtggattctcttcagtgtgctaggcactgccctgctcttcagtgatatatagaagcagaattgtatactccattccctctaacagttcttcacctggtaaaagagacaaacacataacagctgcccattgttggatatttactgtaaggcaggcactgtgctgttcattcagtcattgcagtaactctctgaagtaggagttattatcctcattttacaaatgatattatatagccttagatttgtaatttgttcagagtcatacaattagagagtgttggacttgatcccacatctgtgtgactacaaagcctatatgttgtcttaacactgtctgatactgtcaccacaaaacattttagtaaaatatatcatataatagaagtataagtgaactactaagatcaccaagaaggaaaagagtgagagaacagttcttggacaaatgtcacttatcttgatggataactaaatgttcatcggctacagcaagctcagaggggcactccaagaaaggaaagagcacagtatagactgcatagtttgaaagaatatggtgtcttcaaaggacagaaacaagtcctttttgtttcaaatagctaatgctggatttctctaacaatgtgactttctcaacaactataaaaaccaattaacaagaaatattcttaaaagaattttaatgaggattacctcactttcttgacttatttattcttacataagttgttatatatatataagttattgcatatatatatattattatatataaaaatatgtttttttttaccaatcaaattaaggagtttttaaaataataagcagctttgggaggctgaggcaggaggattgcttgaggccaggagtttgagaccaggttgggctacactatgagacctcatttctacaaaaaatgtaaaaataagctagccatggtggtgcatgcctgtaatcctagctcctccgaaggctgaaatgggaggcttccttgagccaccactgaggggttgtaggctgcagtgagctatgatcacaccactgcactccaacctgggcaacagaacaagactctctctttaaaaatagtaataataataataataataataataataataataataataagaagaagaagaagaagaagaagagaaaagaaaagaaaagaaaagaaaagaaaagaaaagaaaagaaaagaaaagaaaagaaaagaagaagaagcaatacccagttacccagtactttgggagacattttttatcgctgatagtaatgtaacttagtgcagcctttttggatagatgtttgacaatattcagtaactttaaactttttcgtaccatttgcctaataattccactttttaaaaatatttttgtttttgtttttgtttttgagatagggtctcactctgtcacccaggctggagtgtggtggcatgatctcggttcgctgcaaacaccacctcccaggctcaagccatcagcttcctaagtagctgggaccacaggggcacaccaccaggcctggctaattcttcatattttttgtagagataaggttttgtcatgttgcccagcctggtctcgaacccctggtctcaagcagtcttcccacctcagcctcccaaagtgctgggattaccagtgtgaatcactgcacctggcctaataatttcacttctaggagcctgtctgtcctgagaaaatattactaggtgtttgtcagcactaattgaaaacttgaatatccagttatatgggaatggtagaacaaattgtttctaacactaaatgaaatgttatgcagctttaaaaattatatttatgaagagtacattagcatgtcaacatttgagttatcaatttgtccctatggtatcattacaaccataaagggatacaagtgaagcaaacctgtgcataggtaggaaacaaagactgaaaggaagagccatgaaatattactattggttatgtttggtgataagatggggtggggtagttttttttactcttatggattttttatggttaccttaataattctgttgaaaaagcaagtaaaatatctaggtgcagaatagcaagttgcagactgatggttaggcagtctaagaaagaggaactgatgttcttggagccaaatgattataactcttgctgccaccaagttgctctttgttctatacatggggagtcattggtggaaaattttgagaactagtagcctttattgcacaaaggaataatctaccctcaagggtttaaattacttaataactgacttgattttactttatcacttatatttgtccttgttttaagtcctattgtagtaggagaaaataaacatcttttgaaatggcatgcatttattttagtgtacttttctttgtccttcataatttaggactactgatttttccctttcttactgtccaaaaacctataaatcagttttataagaaaggtaaggagtatagcataaactacttctacgtaaaatgtaatttcaaccaccagtaatcatgattttgcagacagtttattatattgcttgagaaatcactataaaagtatgtattaaaataattctttaaagagacattttaaaagatatatgctattctgtattaatgcaaagaaagaagatctgacattcaaaaatatattttaatgatggaaatgaacattagatgctttttctcaagtatttccttggcatttttaggtgattttaggggtctggtgtagaaaatgggcacctattctatttttctgattactgttttaagttatactagactcatttttaaaattttctctttgacaacatgtttatataacattgtttatatgacacttggcatgtaactagtttgaaatattttattacttttttcttacagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtataggtaagaaccttcaaacttactggagtgctaataattactatctaataagttgtattcccatagtttccagattgattaaacagaaacagctggcagacaaaagtcttttctctacagaatatggaaagttcatgttccacagctgaatcctgtttaagtaaatgtttgaaatgtattgaggtttagcttagtattcttactatgcctctgaatattcattctttttccaggaactgaatgaatcaggaactctttcttgactatagagatgcttaacagtttccagtgtttggaaagcatagctcgttttcatattaatggcccataggtatgctttccatgttaatgcttctattcagattaaaaaagaaaagccttagaagatgaagtttgtttttggtattcttttgatgtaatcatcttcatgcaatagcatcgtattaaatgtaattgagaaggtttattaataaagattatttaaagatttttgtacatctacagaaaatatattgatgttggctaatttgctcttgctgcccaacccatcccttccttattctaattataataattatatgaaacttccgaagctttttgcctgttgagactaggaaagtgagcagggttcagatttaagacatacaagttattaagtaacaagggccagtggagtcaagcaaggtgacagtataccctttccctgagttaatgtagatttggagatttggccaaaaaaaactggagagggtagctgggtcacctaagattcagtattcaaagagggctctagcaagctcaggaatagttcaggcattttattgctttcagctggtcccatccagtaggtggaagccagcagtgaggcattcagacaatgtatctaatctggaattcaggtttgttcattcttgccattaagaaggaccattttgcacagcaggatcctgaaaggtagatggcaggtgtgggaatcaggattcagcctgaggaaataggatcaaaggagctctaggccagggtttagtgcaagtcccctgctttaagaaaggggtaactagccagttgctgaggagtaacctagggttacccccaggctgcttgctggccctctctcctgtgcagctcataatgggtcaaaagagctgattgttagactcaggaactttgcaagacagttgttaaactactagtagcttaaattggccatggtgaaagtatttatgccgcagatgcttgcaaactcaatcatatcagctctcctacaccaagagccatttgttaaacccttaccagcaacaactgcctctctttctcaaatatattctcatttactgggtgcctgtgatataacaggtacttcaggggcaatgaaaatgtgggagatgctggtatagtggaacatgttatgtgattcaagaactcatgcctatatacctgatacctgcttgcaagtctgcttggcgttagccaaaacttaagtgcaggattaggagatgaattcttaattctcagcccttcattaagttcactcagctacagtcgctctataggtgggtggcccgtactaaaaatcatcaggagaggcagaggaaagtaggagggggaaaggggccgagaggaacagctatgacctcttcctaaatttgtagatatgcagagatcacagaagcctcattttgcttacttcaagcccaacctaaggatactctgtatataacctcaacctttgaaattgttaaactgaggcaagccagggaccacagtaatagaaaagaactgccaatgatggacttgtttccactttctgaaattgtaagagaagattggcttcagtctgttttattgatatactcccaaatcatgtgtttatacattttcatctaagtctgtattcagcaaagttataagagctcataccaaagataggcatttgaattataatcaattcctaggttaaaataatagaacacttgtttaaagcggggaaaaaaccttgtatgtaaactgacgtggaacccaattttggtacatgaagctagagtggtggtcatgggctagatttaatataggggtggggggtaaatgtaggaggaaaaaggctcacatactttctaaggagcattttctgcataatattctcatggatgcctttccctacacagaatgcatctacttgaacatttatattatctcagtagtatgactcctggttagtaataagcaaaagttatcaatatgcatgataatatttcttaaaaatgaacttagtgatctagggaaatttttttcagaagacccaaaaggaggcaagtaattaaaatacaatggctaaaaataaaattcaactagcatttattgagtgatcaccctgtgccaggcattgtcctaactgctttaacgcattatctcatttcatgctaatgacaactctatgggaaatgttctatcttagagattaggaaactaaggtttagagaagttaagtaacttccccaaggtcacagacctagcaataaacagagctacaattcaaagctaagaagtgttggactcctgagtctagactctcaacctctatgggtcccctgaaaagaaggatctgaattggaggttctctcagtcagcctctattgtcccacttcagaccatgcaaaagattcctgtctaagttttaactgatgaatttttatgttaactgtgtctgtgatgtgattacacagtactcaggtatggaaaacctgggttcaaattctgtcacttatatgtatacctatatcattatgcacttatggaaatgaaaagagataattcatgaataattctaaagtacttagcattgagccagcaggcctaggccctcaaaaatgtgtgctggtactattttagctgtcaatatcatatagtgaaaagaatacttaactaggaggcagaaaacctgggatttttattcatggccctgccatcaattagtaaagtgatcttaggcagtttactctttgactttctgttttcttatctgtaaaatgtgatgattataatagatatcaacaaagtccattccagttctgaagtttcatcattctgtaatttggaattctgtaatttggctttggcttcatggagttgacatctgtaaggctctgcagtatcaggtagaaatttattttgatttgttttgaagatgcagatttcctttgatattctagtggagctctaattagtttattcagagttttaaatatataagttttattaaatgttaatgaaattatttttcaaaaactgatctggaaatgtgttttatatttgtccacttgaatgaattgtctaagtcccattaccaatttggctatccagaaacactttatgtagtactttctttcctgaaaaaagcactgttccataactggtgttttctggaagccccaagatagtaaccttaaggataagaaaaaagagaaaaatataaatggctataatgctaactttcatggggagggaagcagagagagcagtaagttgggggtggctagctccatttctgcattctaaagtgaaggagtcattgcagtgtctttaaattggagggactaaaagagatattaccatgaagctaatgttctaagaaaggtccaggaaaagttaaaggcatcataagttaaaagtgaaagaagtaacatgtcatgtgtttccacagtgttcatatgttttctctggatattaaaattctttttgggtgggcacagtgtctcacatttgtaatctcagcactttgggaggccaaagtgggtggatcacttgagctaaggagtccaagactagcctagacaacatagtgagaccccatctctacaaaaaattacaaaaaattgtaattgccaccagttgcagtggcatgcacctgtagtctgagctattgagaaggctgaggtgggaggatcacctgagcctgggaagtcaaggctgcagtaaaccgagattgcatcactgtactgcagcctggatgacagattgagaccctgtctcaaacacaaaataatttattcttttctataaggtaactccagtggcaactggccaatagcaatttttgcacatatgtatgattgtatgatttggtttggatgtttatcccctccaaatctcatcttgaaatgtgactctcagtgttgaaggtaaggcctagtgggaagtgtttagattataggggcagattcctcatgaatggtttagtaccatccttttagtgataagtaagttcttgctctgggttcatgaaagttgtggttgtttaaagaatgtggcgcctccccactaccttgctccctctctccccatgtgatgcgctggctttcccctttgctttctgccgtgatcatagcttcctgagacctcactagaagccaagcagatgttagtgcagtgtaccgcctgcagagccataatccaaatatatcttttttctttgtaaattactgtctcaggtattcctttatataatgcaaaaatagcctaacataacacgcatctcaataattgccccattgtcacatttcaaaaatacctgtgaggttgttatagagatattggctttctgggttgttttgttttgagaggacaataacatttgattattaaaaaaaaatcctagcacaatgtggcttgtcattgtttattgttttctatacaagtcataaaccattattatatgtgctcatgttcctttatatagaaatcatataaaaaaaggattttgttttactctttaaaaagttttcatggctgggcgtgattggctcacttctgtaattccagcacattgggaggccgaggtgggcagatcatctgaggtcaggagttcaagaccagcctggccaacatggttaaaccccgtctctacaaaaatacaaaaattagctgggcatgatggtgggtgcctgtaatcccaggtactcaggaggctgaggcggaagaatcacttaaaaaggaagaatcacttgaacctgggaggcagaggttgcagtgagccgagatcacaccattgcactccagcctgggcgagagagcaagactgtaaaaaaaaaaaaaaaaaggtttaataattttcagaaaaggtaaaatcatagttcttatgtaactataaaaagaatatatgtcaaaggttttatttaactaataatttatttatctcattaatttgtaagaatatcacaaaaaaattcaggcacaggggacctacacagataacgctggttatctcaagagatttttattctataattcataagggtcttaaaaattgtcactcgatcatgggcattattcattattaaagtatggctctgggtgatgcttctagaaagatggaaatacttttgacattaaattatgaagatttggtttaatttgacatattcaggcaactataatgaagagcccaaaagtgaatattgaaaatcctttgagtgttgtaggaatacagtgtaatataccaaggtgactactttaatcagtctggcttttaaaattacatcttccctcctgtcttatacaatcagcttgacttattacttcagaagaacatcttattcctattgtgctttcatttatacagcagacatattttgggaatattcattcattcgctgaatgtgagcacttgctgtttatcagacatgggcaagactctgagaaaccagtaataagactcagtttctgccttcaggcaccttgcttcatgtgataaccatacttattaagattaattttgaaggtttagcagaataaagatcttcatgccatggagggttgtgaaacacttacattaattaaataaagcctatgacctttatttaagttccagagaagcaatttagaaaagctagtatcagttgtatgtgatggcttaagaaaaactgtttagatacatctttaaagttattgattttttattagttgtatattcagctttagctgtgattcagaatatttttaaatattttactttatgaatttgccttttggctatatttctttgtaatatattttagtggttgctctggggtttccagtatgcatgtctaatcattcacactctatttagaggtaatatttcatcacttaaaggaagatgggagagctttacaactacataggttcctttactgtcttccatttataattgtcataaatattacatctatatattcaaaaccctaccagataagattttaatctttgtttcagtaatcttatatattttaaagaactgaagagggggaaagtggtcttttgtattcccagccatttaccatgttcagtgctcctttatccccagagctccaggtttccctctggtagatttttcttcagcattaggaacctccttttgcatttcttttagagcagagctgctagcaataaatactgttttccttcatctgcgagtaccttttttttttttctctcattcctgaaggatatttttgctggatgtaaaattctgggttgacatgtcttctagcactttagagatagtatttcatgttcttctgtcccctgtggtttctgatgaggaatccatgttcattccaattactgtttccatatttgtaatgtgttgtttttctctagctgttttcaagacacctgcttatctttagttttctgtaggttgattattgtgtgtctggacttggtttctttgattctatcctgtgtggggttctctgatcttcttgactgtaaatttatgggtatattgttttggttttgtttatcaaatttgagaacttttggcccttttttcttcaaatagtctttctgcaccaatctctttctcttctccttttggaattcaagtgttaagctttttaatattgtcctacaaatctctaagactctcatttttttttccccactcttcagattggataatttctattaaatttttcacttctaaaatttccatttggttcttttttgtagttcttatttatctgttaagaacttatatttcaattcatttcaggtgtgtttacctttacctcatgaaatacagttgtaacagctgcttaaagtcttaaatgcctgtgtcactgccaccactgtaacagtcccctctacatacacacacacacacacacacacacagacacacacacacattggatattgggtccaccctcagggcaaagccaggagagagagaaaaaaaaagaaaagaaaaagcaacaagatttcccctacactcttaaaaccacaggggacttaatttccagacaatattcctgttggagctttggatgtgtccttaccttcactgtgcaccacaatatagggctcactctcgagttaaacttataaaagaagacacaaaacaacatgaactgggaaattcatcacaacgtcggttatagccacaaattggactttcctctccaatctgcattggtctgatttacttttcagaattctcaggtatttatttgctttttgtgtcttttacaaggtttttaattgtaagcagcatgagagttaggctgcagtgaggttattccagtctgggctggcaccagaaatcctgccatttaaaaataataataatgttttctagtccattagccaggacttggttttctgggaaacttaataggggatttcctctaaaagtgatacttttatatctttacatcttgagcacagatcagctacatatagcctaatcagtaattactgctcccaaggagttgtcagcattaacttgattcttcccgtgtcaccaataagcacacactcagagggcagcaatggtgttctctctctgcattcctcagggctttcctttcatatactatcaaatcaagttagcaggggaaaatgctgtgagattcattgcccttcttgtcaacctgccttccccagcacatgtgactgatatatacaattttaaaatatatatgtatagttaaatatatgtgtatactctgtagtgatgtcccttatccatagggaacatgtttcaagatccccagtggggcctcaaattgtggatagtactgacccttatatgtactgttttttcctacacatacatacctatgataaagtttgatttatacatttggcacaatgagagattgacaacaataataaataacaaaataatacaattacaacaatatactgtaataaaagttatgtgaatgtggtctctctttctctctcaaaatatattttcagaccacaggtaattgcaggtaactgaaaccacagataagggcaggggattactgtataaaattggccctcagtattcatgggttccacatctgtggattcaaccaaccatagatcaaaagtattccaaacaaaattgcatctttacaggacatgtacagactttttttcttattatcctctaaacaatacagcataacaactatttacatagcacttatattgtattaggtattataagtattctcgagatgatttaaagtatacagtaggatataaataggctataatgcaaataccaggtcattttatatcagggactgggatatctgtggaatatggtatccacaggaggtcttggaaccagtcccctgtgaacaacaagggatgactttaaacatatacatttaaaaacgtatttgagatacttcccaggataaataagtggaatctatacctacatctaaatctgttttacaaagctaaagcaaaattaaaagtatgataattataattttgaaagtcctattaatagagtataattcatattctgcataatttactggtcctaaattatgctgactgtatctttaagctatacatagcaatatgcttttcatccttaatttaaaaacattgtttaaaaactaaattatcaacttgaatttttaatgaatattaatattaataatctacttcaaatgattttccaagtagatagtaagtctttgagttaacttctttttagaaatattagactaatgtggcaataggcttttccatgcccttcccacctggagcaacctctaacagaaatgagatcttctgccagcacctttatacatagcagctgtattattggcagttctcatttaaataaagatgtatgtagttgtttttagcataatcgtattagttgtgtttataaatatttaaaaattggtatttgttttgtttaaggtaatggagtccagatttgaaattgcctcatgtcttgactatgcagcccaaggcagcctcaaaaagtcatttttcttcttgtttgtttggggcttttttgtttgtttttgaagaaatggctgtgccatctggtcaaatgtgaagggattgaacagttctgagggaatttaactaactccttagtgcaatatcttgttacccattaatgtgtgctaggacctaacaaagaaaccaactgaaaacatttacttctgccatcttgcaacttatttacctgattgtatcttttcaaacatcaactagactaaaatacagaagttaaagtttatttgaatgtatcatactgaaaaagtaggtcatagcacacttctgtgtaggatactgtaatgtttaagataggttatctaatatgggacaatttctgcattttgaagttttataaatgccaaaggtctaatgaagggtcaaacttgaaatatggagtcctatgagagctcaggattagacctctcggtactaagttttaatcctgattctactccttacagctgtgtgaccttaggcaagttatttaacctgtttatgcctcagtttccttgtctatgatatgagaataatactggtagcagcctcctagtgttgctattaggattaaacaatgtatgcgaagttcttagctaagtgtatggcacaaggctcaatgactattaataaatattgttgcttttgtcatcattgttaatatctttaagtgtttttttaaagtagtggttgtaaatggtaaaataatgcatatcatttcaatgtaattctagctattgtggtttgaaaattttcagttacagtaattgagggttttttttttatcctttcatgaataggactgtagaaatgtgccaaagacatttgagtaaacgaacagttgaaaaatcataaaatggcttcttacacctcataaatcatatcttgatttcatttagttattgtgactttaagaaaaagattgaattatatgcctctttagaattaaggtttttgttaatatccctggaaaggcttagaattaacctgtgactttaatgtcataatgatcacactctgaacatttatctggaaatttagctgctgtgaacattgcttgctggctaataatatgaaataaaattattactttgacaggaattagcaagaaagtagatctcttaaatgagaggcattctagtgtatcactcagagagaaaggtgatgagaaggttaaataagaaatgacccaaccagctgagggaaataatattatatgaggaagggtattagaacagaaatcagaaatcttgacttttagccttggttctaatgccaaagctctttcatgcaaacagctaaatttcttggtgctttagttttctaatctctaaaatggtttgataatatctgctgttagtcaattaatggttaaatctgagtttcaagtgaggtgatatttatgaaattaagtggaaatatgaaacattattcaaacataagttgggacttcagtgattattagtattaaaagggaaactttcatttttagacacgaggaaaagattagtgccctggcctttgtgactcccattgtaatcatcaacatttacttaaaacaaatgaaaatggggggaatcatttaaaggcagtgattagctttaatgttacaaaacccaactttgcttagagcagaaaagaggtttacagttgggattaagttgatcttccttggatatgtgacttcatttttttttttttttttcactgaatagcaccttgtgcttacttgtgctgaattttaatcaaatgttggccacattagaatttaatatgaaacaaccaaattttaataagaaagagatcaaggacaacacagagcagcacataaaatgaattaaaaggaattaattgaattgatatttcacatattatctgctggttatacttaatattcattaagtataaagaatacacttccttctagcaagatatgaaagacttggttctaaaagtaagagcaagtggacattgatggtcaaacattccagcagccaatttaatcccttccttttcctgttactatggactgcagacctggggtttcaaaccaggaaatctcttgcccttcccatcacatcttacgaggtgcagagtaggtacagaatcgcagagcatgtgaaatactgcttatagagttagccaaaggtctggatatccacagggagatggtggcacttaccttgcatccagagcaatttggaactggtttcttggttgatttttgctgtcctgacattggatgatgatgatgattattattattattattattatatatatttttttgggacagagtcttgctctgtcacccaggctggagtgcagtggcgcgatctcggctcactgcaagctctgcctcccgggttcacaccattctcctgcctcagcctccctagtagctgggactataggcgcccgccaccacgcccggctaattttttgtatttttagtagagacggggtttcactgtgttagcaaggatgatctcgatctcctgaccttgtgatccgcccgcctcggccttccaaagtgctgggattacaggcgtgagccaccacgcccggctgacactgaattattatgatgtttaatggatctagattccttcacaatttaacttgcaggctttatagagccttcatggactacttttgcttttgtggctacataagaaaaagaacaaattagccatttaaactatagatcaaaaagtaaatatagaaaatatattttctccaagtaagtatagaaaaatgtatgaaactcagtaagcttgtagcttgccttttacatgtccagtggtcaagaagtgactgttctgatagtgacctcttattgcagaggattacacttgaagccgttgagcatagccaaaaccattcacaactttggcctctggcagaggctgcttgggagctttaataacatcaatttcatagatagccacaaataaatgtatcatactacaaataaatgtagcatgataggaatttccaaaatgctgtcctttaaattctctgtaagttctattaagaaacacctttatttgttcttggctggggataaaaggattaagccaaaaaaaaaaaaaactgtctaggaacaacttgtctcaatgaattgggacacaggaagggagagtaaggaatctctaagcactcacctgctaccctaactcctctttaggtgtttcctcctaccctactctagctagctgcttgatcatccttgaaacagaaaactctttgaaatagaagttctgatgttcacttgtaaattattttgaagtctcatttcagtcccttctttgaataaaagttgatacacccagacacctttggaaaaggaatcagcactctaacttctagtttagaaaatggaaagcagtctattttggcttgcagattatttacttccttgatacaacactgaatacataacgaagtccaattacactggatacttctaagtgctatctaccagagacaaagagttttgatactttttacaatatgaataaagagcactgaatcttaaaaagccaagtgtcataaaaatctgtttatttcaaagtaaaatatctattataaaagggaccagagtgagacttttagatcaacatcattttcctctttattctcccttctcttcttcgtgtccataaactgctgttgtgttaagtgctctcttggctgtggtaggtgctgctatttcgcatttcactggtaggaaggcatagggagtcccgaggaggtgggttaggattgtagatggaatcagtgggcccggttagtgatttgaagtgacagccagtctttgcctgcttcctagccttccaaaccaaggtgtctccatccttcccatcctctgccccagctggccttgtcagatgcttttcctcactgtactgtctcctccctgctttcaggtgctgttaggttccaagcataaaaggttaaaaagaagaagaagaaaagaagtgaattcaatttcagagtttcattttgagttggctgcactgaatcatgttgtattttacacaattcaagtagtaaccaaagacatacttaactctatgaatgtttgctaagggttaaaagaaatagtgagcagcacttcaaaagaccacttttatcagatttactggaagccctgccaaacaattaagtgaaatgaagggttttttctgaagaagagcaaacctacaaacaaaacgaatgcagtcttaatcaagtcttcatgaaagtcttgattcatctgggaactgagttggggctttctgaatcttctctttaggtattccttatgacataatatgatgaaatttggagcagaggattgggattttttggttttgtttttctttgagacctggtcaacccagaagaaaaacaattattacagctttgtcaatacaaatgccttatgaaagtgaaatcgaactcactctgaaccaaatttatggctgtgggcagtttgtcatttattctgacacatttcctaccttctgttactcctcataagataagactttctcctgtttctttggcatagggacaggagcgtaaatgtgctcatcaacatcagcaggaatttattatttttgagagattcctatgacttgaatacatccagaagaggtctgaaagagcttccaatatgaaatagttatctgtttgtcactccatttatattacattcataggctcctttaatcttagtttatctggtacattccccagtgtgttgaccctgaagaatgtgtaatatgaatcctatattgtagacctgatgatggaattaaggagaagttaaactgaggacaggacaggaagactaggagtcatgcccctcattttctagccattagagcataagggactaaagggtgacttttgaacttgagccgtttctctgggattctgacacacctttctgctactacagctgctttcagagtttcattttgagctggctgcactgactcatgttatattttctatgatttaaatgataaacaaaggcatacttacctctatcaatgttaatgactacaggcatatgcgaagtagagagtttagcaaaaactgggaaaagggccaccagccctatcctgcattcaattttcattaaccatgcaacctgtatttttctggatgttcctaatttcagttattctgttttatcaaccctgtaaattcaggcatactttaaaaacccgttatattaatattttgttgggaaatagtcattttggattccttggatggatttcctagacttttacagttgctttaatttctaacttctcctgtgctttctactatggccagttggtttattgtgtctcctattaagtcatctccccctgtaattgcccagagtagactcctaagcttggtgccagatggtcaggtcctctaacttgtgccaaaagagaggcaactgcacaaaacccacttcacttaccttgaaaactcttatctacattatcagactttgctattcccccagtttataccttgagaggagggcatcaaatacccactaagtgttttttctttttccctttaatttttataaatgcttggtaaatagtgctattttgtctttaagtcctgaataacttataagtcagcatatgtttaggatcatcctagaggtgatcattcagcagtactttaaaaattgtgtgtgtgtgtgtgtgtgtgtgtatgcagatagattttttacatttgaatttactgaatctgtgtcctatttcattgttttattcactgatcaatatatttttaagctcttctcttttagtatatgagagtcacaccattctcgttatcagtagcatagtattctatgcagtatttatggtgcattcatagtttattttatatttatctatagatagatatttagtttaaattttcccaaattgttaatatttcaaatgatgttgcagtcaacttctttggacatttacttatatattcttaagtgtttctttaaggtacagtactaaagacggccttcctgattccaaggacatgtacatttataattttgataaactttcattgtcaggcttctcctctgctcatgcaaaaatactgcatgtacacccttatcaaccatccatgggggaatttgtttcttctccttctcccccaatataagatattatcaattttttaaatttatgctaatctatggaagaaaaattgtatttcttgttttaatttatatatccctgattaagaatgaagctgagcagagttttcctatttttcataaagcagtgctctccaggaggattcaacagctaaaggtaaaaccaaaagcttaaaaatgctttaagaaactataggaacatatataattacctaggaataaattcataaagtaaaagttaacagattttttttaccatatgtgtttaaaaagtatgcgtgcaaaaagcatcagaatacagttaaatgactgcctcttcacgtgaggaaggctttgctaaataaggcaaacaaaacactaatactcagaatatataaggagctcctacaaatcagtaagaaaaagaactcaagagaaaaatgtgtaaataaattctttgtagttgaggaatcctgaatggccaatgaatgaaaatgcttaacctgcttgctttttttcccctgttaacaatataaaataactgtcttatgtcaaccatatagatcttcttgattctcttaaacaattatacagattatttatttatttatttatttaaacattaatctgttgctggatatgtaggttgttttctatttttgctatgataattctccagtatgtttatttacacacttacctgacttcttatttggattaaattcctacacattaatttcctaggtcaagtgacatacacatttaaaatcagttatgtattataaaatactctccagaaaggaattaatgagagtggacctctcatcacaaactaccaatacaggcattatcgggtgttgttttttttgttcttgttgttgttgtttttgtttttgtttttatttgagacaggatcacactctgtagctcaggctggcgtgcagtggcacaatcacggctcactgcagccttaacctcccaggctcaggtgatcctcccacattatcctctcaagtagctgctactatggggactacaggcatggcaggtgccaccacgcccagctaaatttttttgtattttttttgtagagctggggtttcaccatgtcacccaggctgatctcaaactcctgggttcaagcaatatgctcacctcggccttccaaagtgctaggattgcagacccgttgtcagtttttttagtcttagcctatctgataggtgaaaatttctatcttatttgaagatttgtttctttaattattaagatttagtatattttaatgtttgtatttttaaaatgtttatatgccatttgcttttattgttttgtttagtaattttcatttattgcttattctatcctccactggtttttctgttggtacctatattgaatatgtgaactctttatatattaatggtatcccttttcttttactgtcacatatgttacaatttcatcttttctgtcatttgactttttattctgttcatggtgttctttcacaaaagttttgtgtggtcatatatgtcagcccttatgttttttagttttggtgtcttattgttattattgttgatatacaataggatagttaatgcacgttacctcagtatacattattttgctacttggaatctatttctagaaaaatgtagaaagttgattaaatatgccacaaggataaccattctcagcgccatgtaagtttgaatatgcagttactctaacttgttttacttatcctaagtcttacttgtcagttttttatacatcatattaacatttctacatcaatttaatcatctctgttcattattttgttatttatatcacttaagatctgtgttttctctattagatcactgttttatctccacattgtattctcttcaaaatgaagagttatgtctccttgtttagatctatcacggtaccacttacctgataataaccacttttgatgatagctgtggtggtgggacccaaaatagatgcccaggtcctagcaggttacatagttcctacaaactggttgtagatcctaccagcaacagactttttaatcatcctttcaccagacttgaccattatatttaaaagagagaatagtacagtgttactatgaaatggatctactatgcatattctcactgctttaaaaatcactgatgatataaaaagagaagactgcactagcttagtgtttgatcttgaccatatagatctaacgtcatgatcaattgctttcagcattttctttgaaatcacataaggttcatatgtgccaaatttcataaggatcacatgataaggtcaagaaatacaaattccaaggcagaatttatatgcccacttcacatatgacagcaatactaaataaccatatgttgaatataatacactgtatgtaaatactattcttgaaagcaatccaatcaataaaacctaaaataaataatactttaataacacatttcaaatagactgaaaatggaatagatggactctatggcaagaacatccctataaaactgacattcagaggccattaaaacacagagagtaaaacaatcatgaaactaaagaaaaactgtgaatatttagaagttttttaaagcctactacactgtatgccaagatacagcagtcgtttttatttaaagagctatttcaataaaagctgtggattcctaagtattaaaaagcaaattaagtttaccacaaccaatagccaaaaatactttttaaaaaatatacaatattacccagaaaattttaaaaatacatagtattaaacagaaaaaaagtctaaacagaaaaaaagtcaaaacagaaaaagctcattttcattataattaggattattaagagactgaccaattttatcaatttaaagaaggttgcaggaaagctactgaggttaacttcaaagatctagaagtaaaaagtgattgtaatgtcagtaaaactcttaaaacagatcaaatagcccctaagtagtactaatctactgtatctttgaaaatgtatatgcttttttttaaagctgacaagattgtccttttttctttgtttttaatatcacattttaaaaaatatccaaccattaaactgtaaacagcagctcagaatacataaactttaccttccctcatttgtgatatgaattcagatttgaacatttttttcctctttgttctggaaaacatggttttgtcatcccacattgtacagtgatagtttatctttttcagcgcgagtgcttgtttactgtatgtgcacaaacaaatgaaacaatgaagcttgcaaacagttatttaaccagtttttctctcatttattaactcaaactcatatatcaaaatgagatatttgtgatgtaactgatgtttttaatttcaattttgtcactttagatcctgggaagactctgcctgaagcccttgattattgcactgtttggctacagacagtgcctggagaaatagacagcaaaagtggtattccaccttcctttataacactacagattaaagactttctgaatggaccaggtaagaaagtcataaaatttacatgtgtgtacattttttatgtgaatatattagcatgtatataggatctgttagtaatcttgacattccgtgcaaaaaatgaatagttcattttttcccagaggtgtatgcttttcaggctgcccattttagagatcaaaaggcaaatataaatatgcattaagaattaccttcagtctgacaaaaaggtagttatcaattaaagaatagttgactggaagccaaagccccaatattttatttctacctttcctattaattaactgtatgatcttaggtgattgatctaatcttctatacttcagttttcttacctgtatatgaagaggatagactagatggatgaatggataggaaacatgatatatatatacataagatagtatacatagatagattagatttgatagttaaatgtacctgtttcacatgcttagcaaagtgcttgaaacatagtaattactcagttttagatagatacagatatcaaaaatttttgagagctaattatgtcccaggcactatgcattttaggagtatgtactatagttattcttattttatgaataaggaagctaagacttagaaaagtgaagtaaattgcctaaggtcatagtgacagaggagccattcaaacctaagtctttatgactccaaagaccagagcttaacttctgtactacactaatttgggcataactaaagtttttttctttattcctcgatcttcctcctctgtcttttcttccttcatctcatgttcttccccctcttctgttatttctccctcacttccgtatagtcttagctatttatttaacaaaaattattacatttcactttttgttttgttattttgtagttacagtgcttcagagtgttacccatggaatgagtattagtttcttccttaagaattttatttaattttatttatttatttatttattttttgagaccatcttgctctgttacccaagccaaagtacagtcgtgcaatcatagctccctgtagcctcaatctcctgggctccagcaattctcctgcttcagcctcccaagtagctgggactacaggtgtgtgccaccacgcccaactagttttttttatttttagtagagatgaggtctcgctatgttgcccaggctggtcctgaactcctaaactcaagcaatccgcctgcctcagcttcctaacgtgctgggattacaggtgtgaaccactgctcctggccattaagaatttaaaataggctgggcatggtggctcacacctgtaatcccagcattttgggaggctaagataggcagatcacttgagaccaagaattccacaccagcctagccaacatggtgaaaccctgtctctactaaaaataacaataaaaataaaaaattagctggccatggtggcacgtacctgtagttccagctactctggaggctgaggcacaagaattgcttgaactgggaggcaaaggttgcagtgagatgagatcacgccactgcgctccagcttgggcaacagagcaagactctgtctcaaaaaaaaagaaaagaatttaaagcaatgattttacaactgtcttaagatctctagcaataccccgcaaggcatgaattttaaggaaggaaaaatatttatatatagactttgttgagtacatgtgttgtggcgtgctagtgtacttatgatccatactacagatggagaaagccagtcatggattaaacagagactgaaaccatctccactgactttgtcactggggacgaattcttcttcagcatgtttttctagtgctgggattgtaaaggtgtagaagtatgaagaactatttctaatcttgataaactctagatatggttttaaatatatgaaggaaagcaagaaactgaaggataagcaagtcattaaagtgtaggaagaagcctttggagtgaggtaatagactgaagaaggtgagtgctagtatttggttagtaagcatgaagtaccatatttcattccatctaagccactagcaattgtaaaaaaacattctatatgccactaaaaatgaaaaaaacatatgctctttacactgtgatacagggcctttttattacatcagtttgaagacacttcctgatttcagagttgttcacacatgaaagactgaacacaatagaatagatgcaatagggtaagaacacgtaattagttcatggaagagtgacaggggaaacttggatttacttatttctcagttttagtttcacattcgttttgtttttaggcacactttgctcattttggctagaaaattatcttgtagtttacatttgattgatttgtttgtaaaacaatggaatttgaaagttgatggtaaattagatacaatattttcaaggcaaccaaatcaattgaattttaagagaaatgccaatgaataaatgaaaaattatgtatttacaattctggcatttaacatgactcagtattagaaatgtgatttttttttttttttttgagatggagtctcattctatcacccaggctggagtgcagtggtgtgatcttggctcactgcaacctctgtctcccaggttcaagcgattctcctgcctcagcctcctgagtagctgggactacaggcacgcaccatcacacccggctaatttttgtatttttagtagaggttgggtttcaacatactggccaggctggtctctaactcctgaccacatgatccgcccaccttggcctcccaaagtgctgggattacaggcatgagccaccgtgcccagccagaaatgtacttttttttttttttaatcatactttaagttttagggtacatttgcacaacatgcaggtttgttacatatgtatacatgtgccgtgttggtgtgctgcacccattaactcgtcatttaacattagatatatctcctaatgctatccctccccctgacccccaccccacaacagtccccggtgtgtgatgttccccttcctgtgtctatgtgttctcactgttcaattcccacctgtgagtgagaacatgcggtgtttgggtttttctccttgtgatagtttgctgagaatgatgttttccagtttcatccttgtccctacaaaggacatgaactcatccttttttatggctgcatagtattccatggtgtatatgtgccacattttcttaatccagtctatcgttgttggacattcaggttggtttcaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggtttaactagtttacagtcctgccaacagtgtaaaactgttcctatttctccacatcctctccagcacctgttgtttcttgactttttaatgatcaccattctaactggtgtgggatggtatctcattgcggttttgatttgcatttctctgatggccaatgatgatgagcattttttcatgtgttttttggctacataaatgtcttcttttgagaagtgtctgttcatatccttcgcccactgtttgatggggttgtttgtttttttcttataaatttgtttgagttcattgtagattctggatattagccctttgtcagatgagtaggttgcaaaaattttctcccattctgtaggttgcctgttcactctgatggtagtttcttttgttgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggattgagtttcagctttccacatatggctagccagttttcccagcaccatttattaaatagggaatcctttccccattgcttgtttttgtcaggtttttcaaagatcagatagttgtagatatgcagcattatttctgagggctctgttctgttccattggtctatagctctgttttggtaccagtaccatgctgttttggttactatagccttgtagtatagtttgaagtcaggtagcgtgatgcctccagcttcgttcttttggcttaggattgacttggcgatgcgggctcttttttggttccatatgaactttaaagtagttttttccaattctgtgaggaaagtcattggtagcttgatggggatggcattaaatctataaattaccttgggcagtatggccattttcacgatattgattcttcctacccatgagcatggaatgttcttccatttgtttgtatcctcttttatttcattgagcagtggtttgtagttctccttgaagaggtccttcacatccctttaagttggattcctaggtattttattctctttgaagcaattgtgaatgggagttcactcatgatttggctgtctgttattggtgtataagaatgcttgtgatttttgcacattgattttgtatcctgaaactttgctgaagttgcttatcagcttgaggagattcacagccgaattctaccagaggtacaaggaggagctggtaccattccttctgaaactattccaatcagtagaaaaacagggaatcctccgtaactcattttatgaggccagcatcatcctgataccaaagcctggcagagacacaaccaaaagagagaattttacaccaatatccttgatgaacatcgatgcaaaaatcctcaataaaatactggcaaaccgaatccagcagcacatcaaaaagcttatccaccatgatcaagtgggcttcatccctgggatgcaaggttggttcaacatacacaaatcaataaatgttatccagcatataaacagaaccaaagacaaaaaccacatgattatctcaatagatgcagaaaaggcctttgacaaaattcaacaacccttcatgctaaaaactctcaataaattaggtattgatgggtcatatctcaaaataataagagctatctatgataaatccacagccaatatcatactgaatgggcaaaaactggaagcattccctttgaaaacggacacaagacacggatgccccctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccagaaatgtactttttacaggagctgtacttttgtgtttcttaagatacttttcaaagttaggaattaaatatatataatttctgattttatgtccatgctgtaatagtgataatatatttagagatttaaacttttaagtaaatgaattgaaatagttattttacagcagcacttctcaaacttgattttgcatttgaagcttccctggggagtttgttaaaatgcaaatggtgatttaatagttctagaaggtagggcttgaaagtcatgtctaaaaagctcccagatgaagtagatgctgttggtctgggactgtactttttgtagcaagttttatatggctcttatcaaacttctttttaaaaaattatacatgacttatcatatatgatttttgtttttagtatcagtcacagtctttgagagccaaaccacagatattttggggaacaggacagggtaatgataaagaaagatgaatggtttttagaatggtgctttgattatggaaaatcaaatataatatccaatgaatgatttaagttcttcaaagtctaaaacattttaaacaaaagtactttttttatttgagagaagattagtttaaatgatatatcagctgtgtgtgacttcttctaaaacactaacctaacagcctgtaactgttccagaatttactagcttagacaaaaattttcctactgtaagcaatttgtgatttagagtagataagtagatgttatttcatagagtaattatattgtctcactacacagccagattggcatgctactacattaatttaggaatcaaatggctatagaagatagtgagacttgcataccactaattaaatgggaataacaggacacattaaaacagcttttaccatacgaatgtattattttatagattttggcaactcaaggaaattttattttttccagctcttagggaataggatactaagaggaatgtcatttatgttgagattgggcaaacaaatttcagctttataatgttcccaataacattccctttccttgaagaaaaagcattacaaaaaaataataaaagcactacaagtaatactttttgtttttaggtaatgacattgtgttatcattagaaatctttagctattattatgttttaatctgtatgcatacctatttaagtatcattccagagaatgtcttgaactatattagtaatttccacctattttttttcttgttctttaatgaagggtatagtaacaatgaaagttatgaccctgaattaaccaggcatggtgatatgtgcctgtagtccttgctactcagagagccgaggtgggaggattgcttgagcccatgaggtcaaggctgaagtgagctatgatcatgctactgcactccagtttgggcaacagagtaagaccctgtctcaaaaaaaaaaaaaaaaagttgcaacccttaaaggtagagggaatactgattataactgcctaaccttaagctttcttcaaaaagatgtaaacttcacagcttttgaaatttagccttttagatgtattttgcagggattattttctctaaacaaggtgatacaaatgctgctctttagcatttgtttttagaaaaataatgtagagttcttgagtattcccctatttcttctgttcacctaatggtaccttaatagagcaaatggtaggtcccaacttctacatcaaaaactctttcaaagctctcccaaccccccaccttttccccttgtacccattagcaaggtcagtggcttggagaaacctggaaaacagcagctaccagaaacccactagaataatatctccagcaggtgatagattagttggaacaaattggaaccattgcagttcggcaatcctggtttctttcaagctgtttttaaaatgtcgtcattttaatacacaatctaaaccctgcggaacagtccacagcaggttaatttgaatcatatgatgtgtcactgccctcagctgacatgagctctattccatgtgtgaagccataataaatccattcccaaccaaggaaaattccccgtgagaaggtgaactaatccaggcctcacactggcatgctagccctccataattgaaagcagggccacctgttcccagcacagttagcctatagaaaaaaattagcattagatcagatacgtcttatattgaaaaatcaatcatacttcttgcaaattcaaattcatctgtgaagtgtttggtatgacatcatacagaaatgtaggaatgtgcccacttgatcccattttaaaagtttttttaaccataggattccttaactttgaaatgcaatttttttttaatttaatgagagctgacacatgagaagaagaactggaaatggtgcagatttttctaattaactcagggttatttgcaaaaacatttgagctctctggtatttttttcattgttctttcacgaatttttgagccactgtcattgtagccatgaaatgacatttaaatgacaacaaagaacaaaaatgccacattgggaaaacattcccaagtcatttatgttttattataaattaatgcttagcatgtcacattcatcatataatttaaataacatggttatatcaaacacaagacaatgaatgcaatttcacatttcttttagtgtagtatatatggtgtctatatttgaaatgcatggccactggtctttttctcctaatagaatcacttctttagtctcaccctgtttaactcattcattaatttacctgtctagttgtcagtgtttctgatttcattctggcttctgattggtttcatctctggttttatttgattttgattttaagaatctgttgacttgaactggttataatcctgttttgaatacagttttctccttatattgtatggattaatgtaactattttataggttacaatgattttcatttctactttaaaataattcctaaacatccttaaatgattgcatttccacaaacctttctgatttgaatgaatatttgtacttaaatgctataaaatagtaaaagagttcttaggtacagtaacacagcattcaaataggtttgtttatatgaatataaagtagaaattttaagttgtttacccccaaatagatgtattttttgagtgcttttgcctttcttggttaaccctgcttttatgttattactgaatttattactcagtggggattaactcagacatatctgaaggtaactgattcaggaggattgagatacctggaaaagattaatcaaatagtgtctcgatttttctggagtagaaaatgaggaataaataatgtgattttttaatctttaaaatttttttcaattgcaaatttcaaatggatttttggttacctatttcaagctttattgaggtataattgacaaaaattacaaacatttaaggtgtacagtgtggtgttttgataaatgtgtcattgagaaatggttaccatattcaagctaattaatatatttatcacctcacatagttacaactttttatttgtggtgagaacccataagatctcctcttttaccaagttgtaagtatataatacagtagtatttattaattttagtcataatgctgtagattagatctccagagcttatacatcctgcaaaactgaaactttgtacccattcaccaacctctccatattgtcccttcccctagcccctggcaacaaacattctaatgtctccttttataagtttgacatttttacgttccatatataagtgaaatcatgcagtttttgtctatttctgtttggtttatttcatttagcataatatcttcaagttcatccatgttgtctcaaacggcaggatttcaatctttttaaggagtgaatgctattctattgtaaatatctaccacattttcatcctctgttcatccactgatgaatacttaggttgattctacatcttgactattatgaattgtgctgcagtaaacataggagtgcaaatatatctcttcggcacactggtttcatttcctttggatctatacccattagtgggattactggatcatatggtagttatatttttaattgattgaggaatctccatattgttttccataatggctgtaccaatctatattcccaccaacaatgtgcaaggatttccttttctccacatccttgccaacacttgttatgttttgtctttttgataatagccattctagcaggaatgatgtggtctttcatgattttgatttgtatttctctgatggttagttatattgagccctttttcatatacctgttggccatttgtatgtcctcttttgagaaatgtctatttaggtctttttcctatttttaaaatttggttctttgtcttcttgctattgtgttgtttgaatttctcatatattttagacattaacctcttatatagtttacagatattttctcccattctgtaggttatctcttcatactattggttgttttctttgctaggcagaagcttcttagcttgttgtaatcctatttttgcttttgttgctggtgcttttcagataatatccagaaaatcaccgtccagaccaatatcatagagcttttcccctgtgttttcttctagtagtttcgtagtttttggtcttactacatttaagtcttcaatctattttgaagcttttgggtttgtttgtttgtgttttttgatttttgagtgacggagtctcactctgttacctaggctggagtgcggtggtgtgatcatggctcactgcatcctctaactcctagtgtcaagggatcctcctgcctcagccccccaagtttagttgacttttgtacatagtgagagataaggatctactttcattcttctgcatgggctagctagctttcccaacagcatttattgaagagaccatcctttccccattttgtgttcttgacacctttgttgagaactaattagctaatacatggatttctttctgggttctctattctgttccattggtttgtgtgcctatttttatgccagtactatactgttttggttatagttttatagtatattttttgaagtcagacagtgtgatgcttctagctttgttccttttgctcaagattgctttggttattcagggtcttttatggttccacataaatttcaggattgctttttctatttctgtgaagaatgtttttgatactttgatagcagtttcattgaatctgtagatcaatagcatgggcacatcaatagcatgagtaggatggacattttaataatattaattcttccagttcatgaacacaggatatctttccattgatcaccgttttatagttttcagtgtacagatttttcacatccttggttaaatgtattcctaagtatttaataatttttttagctattatgaaatgagattgttttcttagtttcttcttcagatagctctctgttagtgtatagaaatgctataggtttttgtatgctgatttttaatcacgcaaattcactgaattctaacagtttttagaatgtattaattctaacagttttctggtcaagtttttaaggttttctatatataagaaaaccttaaatgttataaggttatctgtggagacaatttaaattcaccttttcctatttggattccttttatttctttctcttacctaattgctttgtctaggatttccaatactatgtggaataagagtggtgagaatggccattcttgtagggttctagattttagagaaaaagctttcaacttttccctgttcaatatgatgtgacctgtgaatttgtcacatatggcctttattgtgttgtggtatgttccttctatacctaattttttgagagttcttatcacgaagggattttgaattttgtcaaatgctttttctgcacctgttgaaatgatcatatggtttttgtcctacattctgttaatgtgatgtatcacatttattgatctgcatatgttgatcatacctgtgatgacacccgcttgatcacgagtagatttttaatgtattttaaattccgtctactactattttgttgagggtttttacatctatgttcatcctggatattggcctgaagttttctttttttagcatgtctttgtctggttttcatatcaggctaatactggcttatagaataaatttggaaatatttccctctcttcagttttttggaagagtttgagaagaattggtggtattagatatttaagtactgagtagaattcagtggtgaagtcattggaccctgggcatttttttgatgggagattttttattactgattctatctccatactcattattggtttgttcaggttttctgtttcttcattatctattcttggtacattgtatgtgtcccggaatttatccattaggttattcaatttgttggcatataattgttcatgttattccctaaggattctttgtatcagttgtaatgtctccttttccatctctgattttatttatttgagtcttctcttttttgttcttagtctagctaaaggtttgcctgttttttcaaaagactggttctttgtttctctgatcttttctattatttttgtagtctctatttcatttatttctgctctgatctttattttatttccctccttctactaatttggggctttgtttgttcttgtttttctagttccttgtgttgtaatgtgagattgtttattttagctctttcttcatttatactgtaggtatttactgctggaaaattcccctcttagaactgcttttgctatatcctttaggtttaggtatatggaaacaccatttcatttgtctcaagaaatttttaaatttttcttttaatttcttcattgattcattgatcattcaggagcatgttatttaatttccataaacttgtgaattttctgaaattcttcctgttattggttgctagttttataccattgttttcagaaaagatacttactatgattgcagtcttcttaaatttgttaagacttgtgatctgtcttggaggatgttccatgtgcaattaagcagaatgtgaattctgcagcttttggatggaacattctgtatatgtttgtcaggttcaaatgttctagattgcagtttaagtctgatgtttcctgtttaattttctgtctggatggtctacccattgctgaaagtaaagtgttaaagtcctccactattattaaattgcagtctatctctccctttagatctagtaatatttgctttatatatttagatgctgcagtgttaggtacctatatactacaatgttatgccgtcttgctgaactaatgcctttgtcattatataggacttgcattatctctttttacagttttcacttaaagtatgatataagtatagctacttttactatttttgggtttccatttgcatggaatatcttttttcattccttcacttttaacctatgtgtgttcttataagtgaattgagtctcttgtaagcagcatatagttgggtgtgtttttataatctattaatttgctctttcttttcattggtgaacgtaagccatttacattcaaggtagttattgaaaggtaaggactaagtactgccattttgtcaattgtcttctggttgtcttatggactctttgtttcttcctctcgctgtctttctttgtggttaagtaagttttctctattggtatattttgatttcttgctttttaattttttgtgtatctgcatggttatcatgaggcatatcaaaaaatcttatagttataacaggttattttaagctaataacaatttatctttgatcatgtacacaaaaaacctctactcttatactccactacctccctccacattttgaatgttatttaaaaatttacatatttgtatattgtatattccttaacaaattagtgtcattaatatttttatctttgaacctttacactaaagatataatttacacaccaccattacaatattagaatagtctgcatttgatggtatatttttaccagtgagttttatactttcagatgttgttgcgttattatcatccttttctttcagcttgaaaaaaactccttagcatttattgtaatgcaggtctggtggtgattaactccctcagcttttgtttgtccaggaaagtttttatctctctttcattaaagggcagctttgctagatacagtattcttggtttgcaggttagttaattagtttgttttccagctctttgaatatatcatcccactctcctctggcctgtaagatttattctctgttgagaagtgtgctgctcagtgtattagaatatccttctatattctttgcttctttcttcttgctgctttcaggatcctgtctttgtctttgatctttgatagtttgattgtaatatgtctttgggtaatcttatttggattgaatctgattgaagacctttgagcttcttgtacctgaatatttatatatttctccaggtttggaaagggttctgctgttctttatttacatatgctttctacccctttatctatctctattctctcttgaataccagtgaccaagaatttacccttttgatgctgtcccatgaatcctgtaagctttcttcgttcctttactgtgtattttttgcctgtatattttcaaataatctgcctttgagttcatagattgtttcttctgcttgatcaattctgctgttgatattctcttttttatctttcatttagctcattgtatttttcagctgtgggatttctgggggtttttcaaattattctttcaatctcttaaatttctcattctggtcatttattgtttttcttatgttgttgaattgtttatctgttttcctgaggcttattgagtttccttaaagcaattattttgaattacttgtcaagcagttcatatatctctatttttcaggggtcggtcactagcactctattttgtttggtgatgtcatgtttctagttttgtttttttttattcttgtggtcatgcatcaatgtctggatattgaagaagtaggttcttattccagtctttgcagtctggctttgtctgagaatgcccttcaacagtaagcctgtctagaactttttggtcatgttgtctggcattgtccctaagtccatgattgccacagccatcaaagctctagagggcaccctacacccaggcctgccacaccagcccaacaccaggatggaatcccgtggccaccaaggttggcacagtgctggggcatactcaaagcccatggccattcaggtttgtctgaaaccaaaggccttgtagacagctggtagtgattcaggccagtgatcaagtctatttcataggggctatgggatcctgcctagcactgggacaggtcaagaggctcagtacatgggtactgacctaaataaggggctacaagagtctgcctgatgctagattttactatggcaggcccagtggtggagaccaagacaaagtcttacattcacttccttctagttcccccaagcagacggtgtctctctgaatttgctacttggggataggggagagttgacacagagaatgtccttcctactctcttaagtacatcttttcatattattatgatataacaaggtactgtgatcgctcacctcatttctttagctcttgtgaaggtattttcttgtgtgaatagttgttcaacatgatgttgctatgaggggatgatcgctgaagagtcctattccaccatcttgctccaccctcataatatgatttttaaatgcaagaagattcaaagcaaaataaaatattttaagaagctaattttgggctgggtgcagaggctcacacctgtaatcccagcactttgggaggctgccgtgggtggatcacctgaggtcaggagttcaagaccagcctggccaacatggcaaaaccccatctctactaaaatggacgtgatggtgcatgcctgtaataccagctacttgggaggctaaggcagaagaatcgcttgaacccaggaggcagaaggtgcaatgagccgagatcgtgtcattgcacttcagcctgggcaacaagaacgaaactccatctcaaaaaagaaaaaaagaagcagctaattttaataatttatttctgttcatcttacccaaaatatcatttttaaatcatatttaatcctctgccccttctctcttgccagaaattgggctaaggcctataccttaatcatgagagtcctgcctctatcttaattcaattttacagccatgctagcaggctatcttctacatttaagaaatgtaaactagttaatgaaactgtaaggaccttgacttttacatttcctgaattttatgggttccaatttccagtgtcagtgctatattatcatagtttgttttctctgtgatttatcaaaatgaaacagtaaacttgatgtcagaatgtcaactacggaatggaccaagaattttaaaatagggaaaagccttccattatttcaacttttgtttttcaactataacttttattttaggaagaaatgagaaaaattacctagctgaaaatggtgccctcaagggtttacacctctgaactacttggctaagtaatagacctcaaagagtcatagaggctggttgtgcagttggcagggaggtagggggccagtactaggtctcatgcagagaagtcagtagagtcgcagtcatttagatttttttttatttcttcatctagcctaattctgttagaattatttcttctacagaaaagagtgagagtaattgggaaatgtcttcctaggaacatggagtaagccaagttagaagagataaagaacattttctggcttatcctaactctaactttccaactttctgcctgcagtttttttccttactctccagccccatgcctttccattgacacagtcttgagccttcctttcttatccctgtacaatagtctcttttatgccaacaactcccaaatgcagctcttttgacttaatatctaactctaagactatttctacatataggtattaggtatactttgttatttaaacatgttcacagtaaattaagccattttctctcttctctctccttgctcacttcttcctttatcatagtcttcaaacttttttttacaactgctgatgataggaaaaattttctggtcatgtcctctcacaatttactaccatcttcaggccattcttatttttatttcaagtccttctacttttttctttgaaatagtcctcaattatgcctgctacttctctggtgtaggcttaatccttgattacttcctcattctgtttactggtagcactaacttcagattctcttatttactcaataatgctgtcttctatgcccttactagatttgcctcccctgccaaatttatttgaatcttaactacccccttcctcagttgatccagtcaaaactctcctcagcccccaaccctttgtgcacctgttcactgtatttcttacatataaattgcttatttggcttaatctgattctgttttttttttttaagaaaaactgttttgcaagaggttttgtattgctctatcaggaggcatataatgtccaaaggtctctctttttgtgatgctagcacccattggtgctcaatgcctacatttattggaggttgtaaatagtaatattctaattctagcattccttttccatatgttagctggcatacttctttgaagagaagcattccccaacctactatttgagtattcagtagtattgctcattcaaaaaagcaggataaatgcttaattctttccctttatttaccccttttcaaaaatgagttcattctctagcatattccaatggtggccagttagttgatgttgtttgatattattttgaactcattatttttaataattctcaagttgtctcaccattggcagtgagaatctctataaactggcttctctatgttttaaaccttgctgttttcttagtctgcaattcttacaccctttttctttgcccactctaattctcagctgccattaggttagcctaagtcttgttttcttctggaatagtttccctttcatttccattcatgctgatctctcctttttcataagcagattagtaataccattttcactaaatttatctcaaaaccacttttggctgtttctaaaaatcatgtgtgtcatcaaggatgagtatatgccatcattgaaatagtaaaacaaacaaaggatgacataggcaccaaaaaagatacaaaattgttggagtagtggaatatagttatcccttatggttattactaagagggagggaaacttattttgatgagtttagttcagtacatttactttagaaattggtgcaattaccctataattagaacttttgtgttgtgatttggggaggattatgaaatttagaaagtcaatgtttgatcataaaaatacgtttctgagtaattttgctagtagtgatgatgtccagatcccagtgataagtatcatgaactgctgctgacttattcaggtcaagaacctttcatttcatgtctctgagcttcctcatagcacataagacagcatgtagcctgttccactttgtataccatcattaattaaagcacacgtctgccatcactgaggtctttacacttcacaccttcaatgaaagcacattaatctcattgtcatggacagctttccaggttttctagctcttatacctgtgaatactccgtctcccttgtccactgtcatcatgaatacctttacttgaacactataacaaaaacctgaatttcaattgctgaataagagaaaaaaatattatgacctagtaataattttttaccagagttattataatacataaggtcaaccttgattatgggtttgttagttctgtgttttgcatttactaagatggtgaataaaaacatcatttctgtgtctgtacatagccacccgtgtatgcactgaatgttttcttgtaagtcttgcttgtctaaaaaattttttatcttttgcaaataaaattccacaggaagaaacacttaacaaagaagttttctttcataaatgttatgatttgagtataacaagccatattgaattcattgggtttttggtaatagatttcataatacatcataaatgtaagtaatatgatgactaatgggtcaagtaaagttggaacattttaaatgagaaaagagctggaacagttctcaggaaacttttccagttgatgtttggtcccccacaaggtgtgcattaacataaacttatgggaatcacctctggggcttgaattccctctctgatttcattattacaatgtgatacttttcctttcactattaagtcatcctctaagatgataggagcataaaataagtataatttatttgcatttgtctaatcttttaactcaatagtcattccatcattctgtttcctggtagctgttcagaaagttttgaatggtaattaggatctaataattggcaggcatgggtttacttaaagatacagaatatgttctgaaaatggtgagaaattagatctggcagagacatagatgactcagctgggagattctctattactgcatattcctaaaatcaaaactttgaaaataatccatttattaaagttcaatgaggattataacacaattctaaactcttaaacataagtatctgataataattggaataaaatttatagtaacagtctgtgcctggttccctatccagttatatttccagttcctgtaaaacattattctttatagctccccctgtgtctctgttgaataaaactgtcctagtccatttctttaatgttgtatcttaatgatcagattaatatttttatcaattttttaaaagtatcaaaaaacaaaatgtggcttgctcaatttttacttttattttttaagttaaaaaataccagacactatttttgcatatttttttctatttgtaaaaataatcttcctgtcattatcagactgaaaatatttgcaatgaagactaattttctaccaaaaaactggctagatcaaggatgtgaaagttcagagaaacatgttgatgtactttatacaacaataaacagtgctgtttcacttgtgatggttctcattctggtgcgtgcctcctgtcttttggtggacctggtacttttgaaaggaatacctggtattacaatatagcctaatttcaactgcttttttggttcttggcctatcatcttttccaacttgcccaactgggactgccctagccactctgttcacacattgcacagaatatgttttgcaagaaatgtggctcagcactgtctctatgtggtccagtccctccagggtgagggactttgtggcctactaacgtacgtcttgtacagaggttgcactgtatgccctgtatggaaacaaatatacaaaaaacatttgaaaagtgaattacttaaatgtcttaaatagcaatttgtttcttattaaaccttaacagaatcatgtgagtctaggagtttgagtctgcagtgagctaggatagtgccaccacactccagcctaggcaacagaccaagaccctgtcttgaaaaataaataaataagttaacatagcaactgtttgggaatacatatagctctgctagattttcaaacgttctaaaaactttcatcaactgctgctcagtgactgagaggttgcatttgtaatccttaattactaaatttaaggtaatcaaaagaattaaattttgatacataaataacacttttgacataaccttataggaaagatagatcaagtgaccaagtgtccaaataagtaactcccttaccaatccactggtctgagaaagggtcgtccagaaaccagcaccacaaaaagttaacattaaaaattcactgttcaaattcacaaaacaaaataaatctataaaagatttaaataattaaacttttcaaatgatgttttttaaatcagcctgcagcatttttatgctgctgaagttattaaagtttaaaatcacactgagacttttgggacaaactatgagagacagagatccaagattgcttcagatttttcctaaaatatttagtgctgtccaagcatggtggctcacactttaatcccagcaatttgggaggccaagacgggtggattgcttgagaccaggagtttgagaccaacctaaccaacatggcaaaaccccattctactaaagatacaaaaaaattagccaggcatggtggtgcatgcatgtaatcccagcttctgagatttaaaaattaggctatctaaaaattagattattttctcattgctgagttataatacttttttatatttttttgatacaagtcttttgtcagataagtaatttgcagatattttctcccagtacatagcttctcttttcattctcttaacactaccctttacagaggaaaagtttttaatctgatgaagaccaacttataaatttttaaaatatgcctttttggtatcatgtataagagactcagtacagagtttctctgtactgagctgcctggagatggggctagggaaggtaacatcagcattgtggtggccactgtgctgagtcatacctgaagccagcacagcactgggcctcacccaaggcccgtgataacccctgcctggctatccgcctgtgttcactcaaggtcctagggctctataacctgccaggcttgtgtccctccctataggacactgaaatttctccagtcccaggtacgtccagagatgctgtccaggagccagggcctggagtcagaaaccttaggaatctacttggtgctccattctactgagaatgagctgacacccaagccacaactctaggacttgaagattttctcctatgttttcttctttgaagaccttctaattttacattttatatttaaatccaggattcattttgagttaatttttatatacagtatgaagttgagtttaaggtacttttttttgtatacagatattcaacaccatctgtaaactacctttctccattgaactgtctttgcacctattttaaaaatcaactaataattctttggaccctatttctggactctgttctgttccactgaggtacatataccctctccaaaactatactgtcttgatcttaatagctgatagtaagtcttaaaatcaggtagtttgagtcctccaatgttgttattctttctcaaaaatgttttggttattcttgttcctttgctttactatgtaaattttagaatcagcttttctatatttaaaataaatatttctgggattattggaattctgtgaaatctacagatctgggagaaactgatatatttactatgttgtctgccttcgaattcatgaatatggtatgtgtatggtatgtctctctatttatgttggtcttttaaaatttattgtcagcattttgtagttttcagcatacagatcctatgaccatttgattagatttatacctgtgttccttttatttggatatgttataaatactatcttttattttaaggcttttttgttttccacctgcatattgttagtttatagaaactcaattgatttttgtgtgatgatcttgtattctaaaactttgccaaactcacttattaattctgggagcttttccgtagattcttattgggttttcaacatggacaattacgtcatctgcaaatgggcatcgttttctttgttatttatgcccttttatcttgccttgttgcactgtctatgatttccaatactatgttgagtatgaataataagaagggacatccttgccttgtttctgttcttagggggaaagcattcatttcttcataattatgatgttagctgtaggcttttcatatatagccttcatcaggttaagtttccctctaccaatagtttgcctagagttattataaatggatattgaatttttcaaaaatgttttctgcatcaattgatagtatctttgttattgttgtaaactgttaatatttttacattgattgatcaaggcttatagtcctaggacaacccctgttttagttgtggtacatcattagttctgtatgctgatggatttgatttgctacattttttgaggatttttatgtctcttcttgaggaatatccatgtatattgttttttatactttctccatctacttttagtatcggtaatgatggtctcataaaatgaattaagaagtattctctcctcttctatttcctggaggacaggggaatgaagaaaagaaagaaggaaaacaatagatttccctagtccctctgagcattaagagactccttcacactccttgaagccagaaatagagggcttctccttgaactctctctatctccacatgatatccacttctgggctttgggctgccattagtctaggataagggggtaggggaggaaaaattagaaactcatcaccattttggtagtattttgaattctagtcttcttccttagtctacctgttaccatatacttttcaaaattctcaaatagctgctctgtgtaggttttatagctggtttattgccagattttgtaactgcattcagtggaagagacaggttccatcattcctagaactctgaaataatttttaaaaagaaagagtaggcaactgacatcattagatgtttatttggtttttgggttttttgtttgtttgttttttgttttgagacagagtcttgctctgtcgcccaggctggagtgcagtggcacgatcttggcttactgcaaccttcacctcccaggttcaagcaattctctgcctcagcctcccaagtagctgggattacaggcacctgccaccaacctggctaattttttgtatttttagtagagatggggtttccccatcttggccaggctggtcttgaactcctgactttgtgatccacccgccttggcctaccaaagggctgggattacaggtatgagccaccgcgcctggccccattagatgtttttaagatatattagatatttttcctttcaggaaagagataaacaaaacttcaataaatatacctaggtcttgaaacttcattttaattgcttttgaaactggaaatgccatgtgggcaatatgcatatggaatttgtattagttttctattgatgcataacaaattacgacaaatgtagcaacacaaatttatcatctcacaattctatggttagaagtctaggtgagttcagctggttctctgttcagggtctcacaaagccaaaatcagactgttagttggcctgggttctaatctgggggctcctggaaagaatctactttcaaacttattccagttattcacataatctagttccttgtggctttaatattgaggtctccagttccttattagctgttgtccaagggttgccttaagccctagggaccacccattcattctcattgtctcctctgattgtgtattttcaaactcactaattctttcttcagcttgatcaattctgctgttaagagactctgatgcattcttcagtatatcagttgcatttttcaactccagaatttttgcttattttaaattatttcaatctctttgttacatttatctgacaggattctgaattccttctctgcattgttttgaattttgctgaatttcctcaaaagaactattttgaattctctgtctgaaagaaaggtcacatatctctatctctccaggattagtctctggtaccttagtttgtttggtgaggtcatgtttgcctggatggttttcatgcttgtggatgttcatcagtgtctgggcattggatagttaggtgtttattatagtcttcatggtctgggcttgtttgtacctgtctttcttaggaaggctttccaggtatacgaagagacttgggtgttgtgatctaagtttttggtcactgcagccatatctgcattagggggcacccaaagcccagtaactgtgtggctcttgcagactcacagtggtgccaccttgatggtcttggataagatccagaagaattctttggattaccaggcagagactcttgttttcttcctttgctttctcccaaacaaatagagtctctctgtactgagctgcctggagctggggctaaggaaggtaacacaagcaccgtggccaccacaatgctggtggccactgtgctgagtcatacccgaagccaacacagcactgggcctcacccaaggctcatgataacccctgcctggctatccgcctgtgttcactcaaggtcctagggctctataacctgccaggcttgtgtccttccctacagggcagtgaaatttctcttgtcccaggtacatccagagatgctgtccaggagccagggcctggagtcagaaaccttaggaatctacttggtgctccattctactgagaatgagctggcacccaagccacacacaagaaaaagtccttcccactcctccctccactttccacaagcagtggagtctctccccatggccaccaccatcccaggcctgcagcgagtgctacgtggctaccacagatgttcccacaaggtccaagggctcttcagtcaacttgtggtgaatgctgccaggcctgagactctcctcaaggcaatgagctcccctctggcccagggcagcccagaaatgaaatgccatccaagaaccaaggcctggaattgggaatcccaagaacccacttggtgctctttcccactgtgggctagctggtacctaagctgcaagacaaactacccttcacttttctatctccttttctcaagcaggaatccctccctatagccatcacagctgggaatgtgctgggtcacagctcaaaccagcatatctttgagtgtctcacccagggcccatggtgagtattgcctgggtgctactgctaattatttaaggcctaatggctcttcagtcagcaggtgatgaatcctgcaaggactgggtccttctcatcaaggcacggttcccttctggcccaaggtgtgtctacaaatgtcatttgggagctagggactagaatggaggcctcaggactctgcctggtgccttatcctgctgtggctgagctggtatccaagctgcaagacaaagtcccctttactctccctctcctctcccagagctgcgagctgtgctgcctggattggaggaggggtggcacaagcactcccttagctgccccatctggtgtctgactggattgcatgccccccaagttcactggctcctagcccagcacagaaccaggacttaacccagaattgcagttcttgtggcctagactgcctttcaggtttatttaggaccccagagcactttagcctgcagtggcaaggcttgccagaactcaggttctgcccacaggatggttctcctgtggctagggatggtctaaatactccctctgtgggtaccagctgagctctgcctggtattgatttccactgtaacagggcagcatgagttccaatgccaagtcccacaatcactactctctcccgcccacaaatgcacagattctctctctgtgccacacagccacccttgcggagatggaatagggttggcatccacagttcaagactgtctttcctaccgtcttcagtacctctttcagtgatacaaagttaaaaacaggtacggtgattgcttacctgacttttggttcttgttaagttccttttttttttatggataattgttcattttggtgttgctgtgagcagggtgattggtggaggcttctatccagctgtcttgctctgcctccctcttggcctagccttgtgaatgaacttcttggagaaaatgctgaagcagtatcccaatgattaaactggcaaagaaagggtacattagataaagggaacaatatgaacaaggcctagtgatataacagcatgggttgggggaagtgggctctgcaaactcagatattataaggaaaggcaagaactctttcttgcttccttgcttgcttttttttttttttttttttatctgaggagcttgttcttttgtttcttaggtaaggaggaggcaataaagagttttaaacaggagtgagccactcagaattgcatttaaaacaaattatttggaaatcactctgtggagactagattaaatctaaagacaattggtctagacaggggaaccatttaggaggctttataataactgaacgatatcaaaaacatggtggaggaaaatagggactggatggaatgctggagagaaggggattggaatcaagcaatgttttggaactaaaattgacagaacttaatcagtttttggcttgggaccagataaagagggaatgaaatgaggagtcaaaaagtcagatttctgactaaagccacttggtggattatagaaccattaactaagacagggaatacagcatgtctgagaggagttaatggattgcttggataaattaatttgacgagcctgtgagagttcaggagaaaatggcgacagacttgcattcactcatattttcttcattacatcattaaacattgtggggccataggcttttggccccctaaaggttatctgaaaatcactgacatgtggcagattgattaatagaaaagccatacaaatgtatgtaatgtatatacatgggagccttcagcgtgaacatccagcatcccaacaaggtacagaagcttatatatcatctcgaggtcacagaaagaatgaggcttggatcctggtaaaacaggttatgggaagggatagaacagaaattctattgaggggcaataaatgattactagggagaatgactggatcagagagcagagaataacttgtaaatagttatctttgtaacttaaatgaccttgggatagtcactatcttgaaaaagggactgttcaggtgtggttacatttttggtcttctttccggtaaagaataatgagataataaagaggggaacaagaacaattgttctccttggtggggcggtttcatctttatatagatagcagaaatgtctcttctagtacttgttaatctctaagagtttttaatttaaaatactcatcacaactgggaaccatattttgaaatgaaatatttttacctccttcagcattcagttagtacttcctgtagatcaaacagtagtttaggtatttagaatattaaaatataggacagtccaggagctcacagctcactgaactatgacagatacctaagtaggtaactacaaaaataatatcagtaggtgcctggtaatggcaaaatgcacaggatattccaaaagtaatgatgagaggcacctcactcatcaacaagggtcaagaagggtgtgctggccaaagtgatccaaagtctgagtctcaaaaaaaaagttagcgcttggcacagtggtgcacacctgtagtcccagctacttaggaggctgaggcgggaggatcacttgagcctgggagtttgaggccaacctgggcaacataatgggatccaatctattgaaaaaagagaaagacaagttaagcaagcagccagagttataaatagtttttttctgtgtccctgggaccacaatggtgcctgagatatgagggtagcaatcagcagctttagtatttacctctctatggatgctttgccagtctgcagtcagggaaaatggatcccttaggttcagcagttggtttatgtggatatttgggcaacctcctgggtaggttactaaattgtttctacagaatgagtacttctgacccttctttagttttcattttatacacccaagaaaaagacagtttcaggatcgaacatctgagtcttctttctactttagctttgttttgtttttgttctaatgatcatctgttaaaattgcaccttttttttattgttgttaaaggtattattttctgtgaggtcatagaatttggaagcccacatacagggatgcagaggcaaatgtgtgagtcattttagccatccaatttatctaaaatatttttcccaccagcctcttccagtaccccaaattctacaagtcaaaaataaaaataatgcctttcaacaaatgttgctgacataactagatatccacacataaaagaatgaagttgaacccctacctcatacagtatacacacagcactaattcaggaaagatcgtagacttacatttaagagataaaactgtaaaactcttaaaagaagacataggtgtaaatctttgtgactttgggttaaacaatggtttcttggtatgacaccaaaagcacaagcaaaataacaaacatattggactttgcaaaaattaaactgttttgtgctgcaaaaaagtgaagataatccacagaatgggagaaaatatttgcaaatcatatatctgatacaatatttgcaaagtatatatctgatatgatatatctgatatttgcaaatcatgtatctatatatatcaaatataataatcttatattttatatccaaaatataaaaagaactcctacaattcaataataaaaggacaaataaccaaatttaaaaatgagcaaagggtttgaatagatatttctccaagaatatatacagtcaataagcacatgaaaaaatgctgaacatcattagtaattagggaaatacaaatcaaaatcacaatgggatagtccttcacgctcactaggataactgcagtcaaatatgtcttagcagttccactgctacgtacatatttcagaaaattaaaaagcaaatttgcacacacatattcatagcagcattattcatcatcaccaaaaactggaaacaacccaaatgtttattaactgataatggataagcagaatgtgatatatgcttatgttgtaatactgttcagccacaaaatggaatgaagtattgatacatgtttcaacatggatgaaccttggaagcattatgctatatgaaggaaaccgggtacaaaaatcacatattatatgattccatttctatgaaatgtcctgaataggcaaatctatagagacagaaagaaaattagtggtttcttggggctggaggggagcatgagtgaggagtgactgctcagtagtatgggatactgtgtgtgtgtgtgtgtgtgtgtgtgttgattatgatgttctgggattagacagtggtgatggttgcacaaacttgtgtatactaaaaacaataaattgtatgctattgaaaggtaatttttgtggcatgtgagttatatgtcaataaggtgttttaaaaaataattcctttacattaaggtgtttttcctgtttaaaaacatggggagaaaggaacattttagtattgtgcacgggtgactcaagtttctgaccctttccaatgcacaactagctgtaaacaagactcagagttttgttaggcctgataagaaaatacagtgtcagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacagaatggtaaagggatcaattcaacaagaggagctaactaccctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcggacctaatagacatctacagaactctccaccccaaatcaacagaatatacatttttttcagcaccacaccacacctattccaaaattgaccacatagttggaagtaaaactctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccagtgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagaaacaaaaaaacccttcaaaaaatcaatgaatccaggagctggttttttgaaaggatcaacaaaattgatagaccgctagcaagacttataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattccttgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaacagggaatcctccctatctcattttatgaggccaacatcattctgataccaaagccgggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcatcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcaattaggaaaagaggaagtcaaattgtccctgtttgcagacgacatgattgtttatctagaaaaccccatcgtctcagccccaaatctccttaagctgataagcaacttcagcaaagtctcaggatacaaaatgaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaaccaccatcagagtgaacaggcaacctacaacatgggagaaaattttcaccacctactcatctgacaaagggctaatatccagaatctacaatgaattcaaacaaatttacaagaaaaaaacaaacaaccccatcaaaaagtgggcaaaggacatgaacagacacttctcaaaagaagacacttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctaaaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaacatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaactccataccaagaaaaaaaaaaaaagaaaatacagtgtccccacatgaaggaaggaacacttacaagggatgggaccctgagagagcctgggtatccaggagcgaagccaaagatcctgatgtctgaggaaggtgagaaggggccctgctcatgaagatgtagaatattaagtatgagtgaatgctgtaatcaatcatgaagccttgatgagaacttctgggtagtccacccagaagtccaactgctgcttgtctcacctgtgccaacatcctggggttgaggagtggagcaaatgttccatttggctgttgcactccggtccaccccgtgtacccttccttcagaggcgatcgccatggctgttaggccttgaggcagaagtgcccacgcacggtggcgagagtgccatggacctctgccacagtggattttatggttgcgggacctcggtgccttcctgtgcacagctggcactcttcacgccgtgtctctgatgacttggtagtagagaagtccctcaagtccttcaaggacaagaacaagaagcttgaggaaggcggccaagtgtacacccccaccccacagaggtggtggtgaataagtcgctcgggcagagggagctggatgagctgaagcgctactgccttggcttctgcctgctgtggatccatgccaagatcgtggtgctcatgctgtggcacatccttgacagccacaccctgaccaggcaaagcgcaggcagtttctccggatccgcgccgacctcctccgcttggtgccgttccttgtgttcgtggttgtccagttcatggaattcctgccgcccgtgaccatgaagctcttccccagcatgccagcatccacgtttgagacccagtccatcaaggaggagagcctgaaggagcttcgggtcaacctggagctggcagagttcctccaggacaccatcgaggagaggaccttgaagaacatagcagccaagggcagtgccaccagacttctccgttttcccagaagatccgggggatgggggagagacccagcaatgaggaaatcatgcgtttttccaaattatttgagaatgagctgaccctggacaacctgtcacggccgcagctggtggcgccgtgcaagctgctggagctgcagtccatcggcatcaacaacttctgcggttccagctcaccatgtgactgcgctccataaaggccaatgataagctgattgctgaggaggggtggacaacctgaacgtcaaggggctgcagccggcgtgtgggaagtgaggtatgtgggccctccgcctcagctgaagcagtgtctggacctgcacctgcatcaggagattcccatatcgctactcatcctgtcccagacgatgtacctcccagaaactcttgccagctgaccagctcaagtccatactgcagactctcccagagattgtggcaaaggaagagcaggtgaaagtggctgaggtggagggtgggcaagtgcacaaggtaaagctggaggtcacgctgcaggaggaggcagccatccagcaggagcaccacaaggagctgcagaagcgctcggagttggagaaggatgtcgcgcccgaaggtgtggaagccacccctcgaaggccaggggcctaacctcagccagaagtgcctgaagcagtcctgtggtcagagaccctgaaggacactgccccctgctagagagcttgaaggagaaggagataactaaggaggaaatcgacatcctcagcgatgcctgctctaagctgaaggagcagaagtcgctcaccaaagagaaggaggagctggagctgctgaaggaggacgtgcaggactacagcgagaacatgcaagagatcaagaaggaactctcaaagactggtaggtgaagaaaaatatgtgaaagcatctaaagccaccaagagactgacagagggtgcagcagatgatcgggcagatcgagggcttgatctcacacctggagatggaccagggcctgcaagctgggcctggcctagggcgcgcccgtaggggagaacatcatcagtgtcactgagctcatcagcaccatgaagcaagtcaggcacattccagaaagcaagctcaccagcctggcctcagcactggatgaagacaagaatggcaaggtcaacatcaatgacctcatcaatgtgattgagttggtggacaaagatgttcatgcctccaccagccaggtggccaagattgtagcgaccttggagaaagaagagaagatggaggagaagactgagaaggaggccgcagaggtgaagagctagagctgctggcctagccacctgtcctcctgctgccccactgccctggcgagggccgtgagagcaattgctttgaggtgattctcagtggctcatctaatacattggctggaatgaatcagagacttccataatcaagtaaattttaattttcatcattccatggatattcacttagtctggaatcccagaacccctccacagaattgtgttggaaccacactgtggtgtggtgcagctgctgcagctgcctgactccagaggccactgggccaggctagggcaggaaggtgcccccttgtgtgtgtcctcccatctcggctgccctgcccccagggaagagaatgaggaccacgcggactctgcccacacagagctgtcagctgcgcccaccctcagaggttcatgagacacagcccagcctcctcggggctgaagatgcctctgttcatctgtgaatcttgatttctagatattggtgtcaatagatctctcttcctgcacacacagaaaaataatattacatatgatttataacttaataataatatgcctaataactttgctagtcctagcttcatttgggattatgtcttctgttacatcctcagggtgtcatgaaatgagcacttgttagggtcagttaagctcaaacatttgttgaatgcatgcatatgtaagacacattgtgctaagcactgggttttaaagatgtgtgacatgctctgtcttgatgcttatagtcttatgtcttattaataatagaaatagagtgattttaggtgaaataagaaggttaaaaacaatacagctagttttcatgtcaggtaagtaagagacaaataaggacaacatgtggtatatggtacatataaaatggactacagatttaaagaaatctcagtctaccaatgttacattgggcaaggtatttgaacttttatcaatgcagagtgtagggaaaggtacagggactcttctggtttgcaacaggtcataagggggaaacagacattttctgcatgaacaattagagaattgtagggatacttggataaatatttattagtaataccattatttgtgtcaaacatggttctgggtagtaaggaaagtcttttttttttttttttttttttttgaagaaaggccagtttcatataggtaacaaactggaaaacctgcttcattttgccttggactataaggggcagagtggaaattgacagccttgatatccttgtgtggccctcgatgtatcagggccacacatgtcacaaggattggccaggaatgtaggcatgtaagtagtccagggagagtgctccttcaagtaacaacatggaaagaatcgttaagtgatgagtaagagatatatcatgttcaggcatcctaatgagtccataatatggatcttgggacacttttatgtaggagcttgtcagagaagtaaaggcttgtattcagtaagaaagcttcaataattgttttctcttttttacttctatagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggtaagtcacagaaaaggggaggggggagacagaacaagtaagatgatttgttaacatctgaaaatgcatcattttgaagatttatattatgtagaagttaaaagttgtaaaggccattagagatgaggacatttctggtttgtgaccttatttttagagataattttagaacaaatcctttaagtaatgtctaaacagaaatgttcctgtcctcttgaggcatgttcttccaggtatctaaaactgttaattcctaaattcctttttacctaaaacagctatagtggaacaacagtatatcaagttttatgaaccataagaagagtgtttctcaaagtgtgatctctggactagcagcatcagcatcacctgggaaattgttacaaatgcaaattctcagaccccacccatgacctactaaatgcaaaactctgggcatggagcccagcaatctgtgcttcaacaagccctataggtgattctgatgcacagcattaagtcactggtaaccatttacttaaaaaagaaaagttggtgttgtggcagatatgctacacaaagtgtaacagaagccaaggttcaactttgcaagaatgctgttgaggcattttatcaggcagcaacacctggcaacgaaaagctgtgcttctgtgcctagcctagcaaagtggggtacagactctgcaaagtgactgccattgatgggaggatatgtgagaaatcaactggcagtgacatctacattttccacttctgttaccatgactaaattgttatatactttttcaaaaagcatgggaagtgtgggcagaaggattgtgaggaggggaagaggaaaggcaagacacaggtgggaaatagcagttttcaatcacagaaactgctactgtaaaatttcagggcacagggccagaaatttggctctgaaagtaaatgtagcaaaagggaaccatgtattttccctctttaatttgtggggggaaattggggattggggatagtgcaggggataaagcaaatccttatatgcaacttagttgcttatcaaaaagtaattaaattgcagctgtagacttactgtaacttagttccacatagccaggttgggcacagtagttaaaacagaaaggaaaagttttatagttgagaagcctgaattttaggccaaaacatagatgatttatttctttctcactagaaatattcgtgaccaagccaactaaaagttctgtattttgtttaattgtcttaaaagttacaagtgaaaaaggtaagtaaagttcatgggtcatgaaagactatgaaatactggagactacagtatctgatttatccacaaataaattgcaacccagacaacactaggtctgttcccatgcctttccagttgtacctcaatcatagcagggaaaggttaagactcaaacaaaatggaagaatttaaacgtactatactcacttttaggtgcttttcttttttcatcctcattgctttttttattcattagttactcatattttatccatgtttaatgatgtctgtctttgggaaacacctctaaaatattaaaaatccttctctcactaagctgtgcaagttagtaaactctagttttggaacttgttttttccccctgtatgtaagaaaaactatatacccctaatccttttacaatgctgttcttaaatctagttaaacacaaaaacagcaactatagctttgactaaacatactttatacaactctaacatgtagtgtccagcaaatgttttaaaataattatttgcatcaagtcaaatcagagttgagattagctacttaatagtaacaattttgttatgagactataatgaacaccaaaatctatttttagtacagttttttctttatgcatactcaaacagtttaggatgataacaaggttagcaaaataataaactgtaattacatgaaataagatttattaacttctagttataaggactgatttcttggaaaattgtgattaagagattgccacatatttttttcaaaaaaattgattttaactgtatttttaaaataaaacataacttaagttttgaatgttaatttcattgtgtagttgaatgtcttaaaaattcatgctttgcaatttggataaaatacatgcaaacatatattcaaagtataattttgataagtggtaaaaactatccaccaccaccaaaaagcaaatatactcacataaaagcctcctaccagtagtcatatttctttttgtagttttcaagtaacattgttctacattcaactgaaattttttatactttagtatatctttgagctcaatggagttgatgtcagatttttatagtttgaatctaatacagaaatacttaactgtgtctttgattttacagtttatataactgttgtgaccatctgcagcagctgcacttttcagaattatttgctgaaccaaattgagcacagtgacaaaagtagtcatctcagatgtactattaaacgaaagaaaaaggagcattgccttggtacagtacagccatctgctgtacagatgttattgtatagaatgacttcagataaaataattgtagaaaattttcattaaaacctcaacaatttgcacttgtttatgtgaatctgcataactccccaatgagagaacacacttggggtttcttcggttctcactcactttctctttgatcctttttgatgtgctgattttaataaacacagtcaaaaacactgtgcaaaaacatcatggaaaaaactacaaaggaacaattatagcagcagaaactactctaatccctaacttatgcaagctatttttagtgaagtatttttttaacactctttatgtgacaatgttatataaacagggtaaaacggtcctttccagatgagttttaatttaggagccgaaatagatttgtaatgctagaggaatcttatgtgctaagtaatatttagagaaacaccattgagaatgtgttttagatatgtttctttgtcaaaggtacaaaaatatttgatttcacctaatgattatatgtttttatcatctaaactgtcataagcttacaggaagtgtatgtggaaaggaaataatatgatcaaaagtggtaagttaattttctcccccgggcattccgaatacatttaaatctgtgctttcagatttatttactgatttataaaactaaatatttataaattattgactgaagcagttaaaggaattcctcttattatcatttggaatgaaacgaaatggttaaatattttctactttaccaaaaatatctaccagttcttcttagcctcctatgttattctttaaccctaaactatgggagtttcataggatttgatttttttttaattccactctgcagatactggtatagcagtgacttagaataaactaactcccatttctgttagaatacttatgttctctcatgaatctttggtaaaatgacccaaaacttctgatttcagtagaggtaatgcttgtatttttaaggttggtgtataatattgctgaaaatcctatgattatattaaaagtacatctcctttagaaattatatcatatattttaaaatattttaaggcagataatatttattttgctattcattgaacccatcccattctatagtattttctgaaaacaaaacaacagaaaaaaagcctttcccttacgtgtatatacaacgcaatcatttttgccatttgaaatatgtagctttggagaaaccaaaagtatatagctataaattgcgaacttgcagtgtagcactttccagaggcagggtggagagtgagctacagactttagctccccttgtctgagtaaattatggctctgtttgggcggcactccttagatttcgacaaacgagcacacagttgagagctgtgaaatagctgaactttaggctgccttgctctttctcggggcacttagattggcagcctccatatatgtagataaggaaaaggaaaatagaatatgagcaagttaggtgccacaaaagattgggggaagaaccttaatgaggtcatcttggttggcattttagtcagaatagggaagaagttagaaggatcccctgtccataaggacttgggtgactttttacccaagccaaaaccagtgagttgaactccttctagtcaaaggactatggtttatgtaactttcactaccccaggctctgtcatccagatgtacttatctttttgaataaacaaaagtagagagagaaagcataaccacattatttttcacatatacaaaatgccttttctcatgttcactgaattcaggaccaataaaatgtaaagaacctaaagttccttttcatgtattgaaaagtgaaaccaggtcattaattgataaaaagtggagctccaacttttcattctatagttaactgggtctcccagggaaaatcttataaggcattgtcataagctttggatgctgcagagatgcgagttagcctaaggggaaataaaatagtaaattagatatgactacctaaaataatatgttgcaataaccagccaattacagcaccccaaagacttttgttacttttagcaagaaatagcatctctgtctaatgcctgaacaataggaaatgagttctttgacagttaaagccagaggacaaacttaacttttaagcagccactgaggattgaagtggaagtacagcttgtagacagctatacaaatcactaacaaaccttaatgaatattgggtgtgggcatcagggtcctgtcatttttgacactatgtcccaagtagcttaaacccaacacttaaggaaaggtggagacctcattgggtctgtaacatctgggtttttatttgtcattttggcataccccacaagcgcaaaagaaagagtaaaaggggattatcttgacaatgaaatgagttactgaatcttgtgataatgaaaagcagaagaattctaatgcctttctatagtccctgaggtagaggtgcgtttatggtttagcagaagtaaaatgtagaggggaagaacagatggcctaccgtccgtgaaacatgacacctcccctcccaggactgagtaccactattaatcctggtcagattccctcctattactttataacaaggttcaaagttgctactgataaactggcatgtacttcttttttcacccttagattacctgtagattactgataatttttgactatgatatatctctgtatatcctggtgaaccttgaggcattcgacaaaaagtagaacaggaatttctaaaaattggctgggaaataagaagaacaagtaaaattatcttaacttttttcaaaaaatgtcccatattatgttttctaatatgacgagaataaaaaccataaatgtatgagatactgtaattctcctgtcctcttagaaattatatgaaatggagaagacatctcaacatacaaattatattctccttgctgtaactgttatatgattagatacactaatcattattaattaccactaccttagaaaagatttttttgacaccctcaagaaaggagattaaaaattatgactgtttgacatttaaaaaaaagcactaggaggtatgtgctgctcagccgtgtttacatagtcatgtattgttttgtttaaccaaattatgtaaatacagtattctacatcttttattttgaggtatatattcattgtcctgtgataaatagcttgtgcatttttaaaatgttgtttatgtacatttttgttttagtgctgtgtggttgctatagctgttttggattccaaagggaagcctttaaaatacataggagaataacttcagagatatggaagatatccactgggttgagtttctgatgtatgtatttcaaagctgcataaaaataaaaattatctaataagcaacaaacttaggatatcagagcgatctcatgtgctgtggtgtagtgaacatgatgtacctgcccagcctttcgtagagggagatgagctcatttcagagagataaccatctctgactttttcttctgattcatcactgacctgaactcgatttgaaccttgttagacaaaaaacaagcagaattcctggcctaaactataaaatataattaagcccttttgaaatgatgtgtaaaagaacattgctgtacccccacttataaccaccaccaccaccaccgcaaccaataaagttaaatcaagcactgcctgtaatggattaaaataataaatgttcctggatttcagtgtttgaagtacttgaagaaaacaggctcccagcagccggggtagctgaatgcaagagagacatttattaatgacgagttcaaggatttggcctgtttaagatcattactttctgtttaccgtgtgttacacatcccttgtatttttacacagcccacatgtgtccacatgcaataatgagaagcttttttcccaacaaaggaattaattgtgtaaatatggttctcttggggaatatgaagtcttcataagactctgagcccttctaatgagaaatccagtgtagtcattatagtcttccatgtaaatccaccttcagatcttatctttaaccaaattagtcatttctggttattggttttagttaccaaattccaaatttaatctagactgtttgctagaaaactgctggcctcagggtatttgttttagaattgtgtgccattacattggacacataattccagccctaataattaagtactagagacttttttcttaatagcatctccttagcattctaatgatagcccctattaggttagtattaagtaaaatggacaagcactgtagccccaacccaaggactgtggaaaaataaaagattagaagtaaatctctatcccccactctactgaatttgtgacagcatttagtgttgcctgtggtcacaggaaattgcccgcttgtccatataagccagtaggctgtttgctaggaaagcttctagcaaagcaaccctgagtgatgagtaactgacaacatcttagatgttcttttactccctggttggtcccctggacttgttggctatgttggcataacatactggggctgagcaagggaactgaggacaggaaaaagcatgtatttacaacccagttaccaattagaaaaatgaaattactaagaactaatagcagtagtttgtataaagcaacatggtgctgtaaagaggcagacagaatctgcaccccagccctgctacttactgaccagctggttgtgtcaaaagttactctgtagtgcatttcccaaatgaaggcaaaaatatttaatttataggactttgagaggattaggtgacataatgtatgcagaatacccgacacattgcttggtacaaattaagtgctcagtaaatattggtctttgtatatattcctttccccaaaatcacaccacatgaatatggaggtcatagattactaaatgtcagagctgaaaaataccttaaaggtcatccttttttatcaataacctttattatccttttctcccattgacctcatggtctaggcacactgcatttagtattagataactaactataccaacttgatacaattttaaccaaaacaaacaaaaactttagaacacctccacaacttagtctcagacaaattcatgatttcttttaggttcttaggaatactaaaaatacctcatggaccaccattactatgtgggacccactaagtgtcaaggaaccttgggttgaagcccatggagctagtcttaactccctcattgagtacagagtgaagaggttaagcggtttgcccagggatactgtatggtggagttgagactagaacacacatctcctggctgctggcctttctgttataccagtctttcaaaacctggattatgtagatcaagaccattttctaaggcactgcagtaaattacttagcaagtcatgttgttttcaacattatttgagtaagtttatatcaatttttccatccatgtaacttaacttttttaaaaaaattgattcttcagcagtttcctcgcataattcaattaaccagctactgaattcatcccagaaacttttcaagtatgtatttgctattattctttcctatgtaagaaggttgtcttacactttccagtatgcacagtcagatctgccagtctgcttttttttttaaacatagccacatgatccaatcaagttatatttttctaataaactaacacaactgtaaaaaccgtgagcatggtggcagattggaggggaagaaagaggcaaagcatatcctccatcaccctttggtatttttagttttcatttttccaggatcctagagttctaaagcatttcataaaaaatacctttcccagacaatggccatgtgtgagtagccagctcagtaggcatttcttctttcatgacaaattcttccttttttttatgggaaagaaacactcctcttccagttacttgtttttccattttcttatgtccaaacaaagaggtttgaattaaactaggaggtcccagcttttacttaccagtaaggactaagtcacagtccctggggaatagaaatctcacctatgagaagtcatcaggtgctttgggaagggaaacatgttagtagcctggccacccatttggtctattattttgatgactagacttttaagttcatttgttggggaatactggcatcttttacagcttaaatgtcagtgtccatgtagttctctggttttgttatgttttgtcccacatatcatttcttcctgtattttagtttaccatattaataggttctctctctctctctgtctctctctctctctctctctatatatatatataggctctctcttttgcgctctctatatatgggcttattacagaattaaatataattaaataggatctgatcaacttacatattctgatcaagggcggggacgaacatgtttttttcatggctagagcacccaaatgccatttttatctgcttcaacataattggttgaaggaatggaagactttatttttgagggatttgttatgtctttacagacaatacttacaaaattttgtcgttttcacattttaaggttttctgatgcttcactgttatgcaaatcagcttccggatgtatctaacacatgcttgctgattttctagtagccttagattacttacagctggataaaataattacctggatatgctttgctagcaatgtcatcattgactactctttctaatgatgcatagaagcttgatttagattgcattttgcttagtcagcatgtagacactaggagccttactaagggtctagtagacactgacaacatagggctggcagcactttgtaaacattttccaaaacaagtggtttgcatttattagtcttctgaaggagtattttagaagtcatgaaactatttgttccttgaagtaaatttttatactcaatgaaaagtatgtcagtattcaaacaaagcatgattggttctgtttatcgtaccagttgtttctgaaattatttctcaatgttgctacacctcgtttagtttaattaaatatctgccattagtttgctaaaacttaaatttaaaagataaacagatttttgagaaaagtcaacagaaaaaatcagcaggaaagcattctgttgaaggaaatgtagaaagaagaagtcataccgtacgattggtcaaagtgacctgatcacataatcactaaatgcaacatgggatcctgagtgggatcctgaaacagaaaaaggacattggaggagaagctggtgagattgaaaggtctttaaattggtagtattgtatcactgcaaatttaatggtttttgagaatcataatctgattttatgtaagttattaacattgacaagctggatgaaggatatcaacttttctgaaagcctaaaattgtttcagaatttaaagtttttaaaaaatgacctgatcagcaattgggtaagtaactttaataatattcatgcttttaaacatctaagtgatgattttatatcgtaaacttttgaagcatatttttaaaaattttgtctttactgtttttggaaatttagggaaaaaactacaagtacagaaaatgtacagggtaattcatcaaatgcctgtgtactcatgagctagaacaaatataaacatttgtcttatttgttataaacacacacacacacagaactttacaaaattattcaggccttttccaatgttccattgttaagaaggtagctctttataatttttacttgtaggcattttgtccaatggtgcatttgtccccctaggaagaagaacacatgtcttaactcactttctgttgccatttataccaggttgttggatgtgtaaatatctagtttacatgaactctgagtattctctgtggccctaggtttatatgtgtggtaatatataagattcaaaataaggaagatatttagtatgtttcctgggaaaaaaagaaaggcctgatgtcccatgggctggcttctcagagtgaaataaaggggaaaggaaaattaataaccctgtcatgagtcccagggattactttcgtattttgtggtaaaagtgtataatttggtttactatcctgtaagtgaccctttgtgaaattcatcaccaccctttattgctattaagttatcacaagctcttaataaatactggctcacgcctgtgatcccagcactttgggaggccaaggtgggcagataatgaggtcaagggttggagaccagcctgaccaatgtggtgaaatcctgtctctactaaaaatgcaaaaaaaaaaaaaaaaaaaatcagctgggcatggtggtgtgtgcctgtaatcccagctacttgggaggctgaggcaagggaattgcttgaaccagggaggtagaggttgcagtgaactgagatcacacactgtacaccagcctgggcgacagagtgagactctgcctctaaataaataaatactggttccaagattaaaagcacttaactaatgtgtttattattatgttgtagctttttttaatgtaggagtaaatgttcaaaggaaatatctattttaaacttaaaagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttccttgtaggtatatggcaagaaagaaaagggacaaaaaggaccaggcaggatatatttatatctgtagattttgtattttcttagtactttctggcaatggctgttcctgtgtcctcactgcaaacattagcatcttattaaattctcagtgtcatttgtgtatttaaacaagctcatgatcagtgctggtaggcctgagttacgggcaaataaaaactgtagaatgactgtaaaaactaagactaaagcaaggggtaggcttgagcaaaagaataaaagagactgaaaaaaaagtgaacagcacataaagtgaataaaaagaaagcaaaaaatattagggtttgtatgatagcagggaagtattcctgttcaacagttcatgtgcttaacagagtcaatattagaaatgttctgggatgtctcttccccactcagtacttactgagattgcagaccttgaagctaatacattgccaagagaaaatctgatatgaaagaaaattgctaattatttactttatcttcatatacccaatatatggtagataaccactaacttttggttgaataatggatacatgcctacataaatatcaaattgaaggtgacccaggatatgtaaattccttagaaacaatcagaagcatggtaatagcacttgtttaagaaattaggcctggttttagatactgtctcataaggacagaaattatggtttaagccatgagagtagagaagtttgctgaaatattagttcaaggggagaatagaaaactgaagattacttattaaaatcccattggttaaagatattatttgtgacactttggattgcacacgacagaaaatccaacctaaactggtttaagcagtttttacgtatgtgaaaagctccaaaccagtgttgtcctgaggcatggaagagtctgtcagatttcttccctctgcgttacgcagcttcagcccttaggctccacatgctgactgccagcagttccaaggccttcattttcttaacctcaagaccagggagcaagaggaagggtcatgttcccaaaagtattattataccttagtggttttcattgaatattatgctcattcctggaccaaatcaatctccagagaatatcaaacataaagtcccataaagttccccatcctgctagactatttcccggcaaaccagtcattggattccgttgtcaccagaacatagctatagctagctcagtgcctgccttcattgcagggcctctgtttctgaagcacattgtgtgtcctctggtcctctttagtgctcacctaagtctggccgactttctctcttcttgttccagcctcccaaatgtttgtgtgatcattggcttcctaattctgtgcaattttactgatatttctgtccccacctttatctttattctcttgagaattctagctatcccattctgtgtccccaagccaaaaaaaaaaaaaaaaataggatttgtgtaatagtaggaaagtgtttttctatatttgttttctaataattcaagtctggaatttttttttcattctctccttgccctagtcaataaagtcaataagaacttgtaattgtataacgttgggggggttaagaagagccttccatcaactctacttaagttctctaagaggtaggcactttgcaagtgatatgcatcatatagaatgatatgaattttgacatttcagtactagttcttttaagacaaagcctcataattttagtacaatatcagtatttagcacaatatcagtattttaaagtggttcctgcataatagagatacctaacatgatccaaattctatatgtattatgttatttctacaaatataagattttgtcatgcttacaaatactcttttttaaatgaaagccactatagcgtgagaaaggaatctcattcctctgtatgctttgtagacaaaatgttgtcaagcccattcctaaagagacttccagaaataaatatcaaccttttatggcttttttttagtagataattacctttgcttccataaacttgttctttatggctttcttagttcttttgctttaattttgaccactccaagtgatgttttaaggtggattagaaacagacacacctgaagaggtgcttagcaagtttctgatggtcatagaaagaggttacaaataaggaaggcgagaagactagaaaccaccctgtgatgttggatttgaacctgaggtatcagtatgcattcatggtttttaatgtatttaccagtggatagagagagagacaaagatatgtaggtatacaggggttgctatacatacatatacttcttatctctgctgaaggggcctagcaacagtgacaccccagtagcaatgagcatacctaccacccagattttggtttctagataccattcttcaacaaaagaaaccagagctccttggagaaatggctggtgctagagatggggtggtaaaaatacaagatgagcctgaaatattttgtggcctgaaagtaaagaagttctcaaaaaatgattggcataggccaggtgcagtggctcacgcctgtaatcccagcactttgagaggccaagatgtgcagatcaaccaaagtcaggaatttgagaccagcctggccaacatggtgaaaccccatctctactaaaaagacaaaaattatccgggcatgttggtgggtgcctgtaatccaagctgttcgggaggctgaggcagggaatcgctggaacccaggaggcagaggttgcagtgagccgagatcatgccactgcactccagcctgtgtgacagagtgagactctgtctcaaaaaaaaaaaaaaaaaaagacaggcatatactaaaaggacacagggaccatcttaaagggctcccaatggccaaagctggttcagagtaagcaacaatgtaaataatgatagtattggattataacccataaaaatgaatattcatgagtccatactgatataaataaataattgaattagtatatggggtagaagggacagctgtagtatatgtgctaccaaagtgggcgctagaagggacagctctaaataagggaaataggaaaccaccattatcacacaccacaataaatcattgcaggtgagaccactggtggatgctaacattagtgggtgaaaatttgaagaaaaagagcatatctgcataatctccaagtgtctccccacaaaaatacttatttacaaggggaaagtgttaactttacaatggcaaaatctgacagacaccactttagccatatgatcagagttaatattgtaaataataaaatattggtatcacatacaccaatatgacgcactaagggggtcactttggtggtattgtcaaaaatgcataacctctttctgatcacaagaaaacatcagataaaccccaacagacagacacgttgcagaatgattgtcctgggttattccacagtatcaaggtcatgaaagacaaagaaagctgggggatgtgtcacatattaaagaatattaagaagctttgatgattaaattcagtatggatcctaggttgaatcctggaccagaaagaggaaattagtgggaaaaatggcaaaaatttaaaaagatgtgtagattatttaaaagtattatatcaatgtggatttcctgatttcagtatttgtactaaaggtacatagctaggtgaagggtgtacaggaacattatacagtatgttttttcaacttttatgtaggcccaaagttatttcaaaatagaaagctttttttttttttaaagtgaggggacttggaatagatgatttctagatctcttccatccagcctttttatgttacagtggtaaaaaacgaaaccaaagatgtaagcagttttatttcctgtctaccaattaagaaacatgttgaggcagctgaaaaataggatcagattctaaactgtcgattcagttcaatggaacatgtcctgaatagctactgttgtgcccaggactacactgaataagctggtccttgcctccagcatggtcagtactagaggttgaaaattgtgtgatcttctctttcactcactcatattattcaggtatctcttctttgatgttttaaaataatggaattggagagaatgaaatagaaattgataagttttagaaatttgtcaaaggaaataagagccttcaaagagggcctgaggtttttcaatctgggtgcctaaagagataataataaccattaaataagataagcaacctaggtggcctttggcattaaacactgtgtacaaggattcaatatgactatcacactaagattacaaacagataattagatatgtcactgtggggttgtacaaagatatgtgtatttgaaaataaaggatgatgcaatcctgacattctgttaatgctcatttactaaataattgtactgaattaaggctatacttttatgcctttatggcaaatttctggatgatgaatagatatatttcatttagcaaatatttacttttagaagttttagatattttagaaatgtaatgctgttaagtcagaaaattatggcttcagttatggactgaagttaataaagatggttttttatttgggggtattttggggcctgtttctatttcttttattttctggagtgctttttttgcttgtttatttgtttgtttagactaagtggaagctttgaatcaggataattgtaaatgaaatggtagtttcagtttcacaatttgatgaaacattttaagaaattgatttccaccatgattatttttaaaccaaagtcttatctctaacacttttgtgggtgtgatgccttctgtggaggattagaggttgaatatcttatttctgcagtaggaatatacaacatatatgaaattttcaagtctctacagaattgaaaagtcaatgtggttactgtactttaaaacatgtgtatactgtgggcctaaggtgttttttaatctttcatcttttttagggatcaaatatcattagaaaaataagccatgggcattacaaacgtggtctggtgaaattcaatattcactatgacaatttagaatatgagctccttgggaggaaagttaactcaccactcttaactttgcatctaaatatcctaaaatgtgccattggttttatgaaaaggttttgatctacactcctattttaagttcaaaagaaagcctacattttaaagtgtattccttttctgggtatatttactttgaactatagcatatagtttttctcataaatctaacctgccactatctgtttttaagactttgtaaacttcaagtggttatgatgtgtgaagtttggattaaactaaaatttttagaaaacacacgttatatattttgattgttttgaattttaacatgggccagtaaaaaacttgagtgtctagcagagtaacatactgcactctgttactgtaggaaatcacagaaaattaccctttcccatcatgttaacaatagacaaatgaagcagctgttcttattcttaatgtagttgcttgaaaaacttgcacaatttaatgaaaatgtctctactcataaaacttaaaatgctcacacatggaaaaagtcataatgttttggcaaatattactttgttaggaatgtgaatgaggtatacctgcttcataactagaactctgtataaacggcatgaaacggtggtggactgccaaccaagcaagacgactctgacaaaggatgaattaatactcttcaaaaatatagatagttctttcccaaacattttttttgataaggatgaattatatactcttctgtatttttttttcaggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtctgtgggtattggccatatttttttcataggttattaactagcctctgttcattttttgaactgtttcactaaattttaaatctttgtgtggtaagaaagggtatttgtcagattgctacttgttaaattttcaacaactttattgagatataagtcatataccagcaatctacctatttcaagtatacaattcagtggttttttagcatattcagagttgcacaatcattaccacagtcaatttcagaacattttcattaccaccaacaaaaaaacccatatccattagcagccactcacattaccctctaacccccttatcaggcctaggaaaccactaatctactttctgtctccatagatttacctattcttaacatttcgtataaatagaatcatgtaacctgtggtcttctgtgaccgacttctttcactcagcatgttttcaaggttcatccatgtttaccaagtgtcaatattttattcctttttatggccaaatgacattccatcatatggatataccacattttatgtattcattcatcagttgatagacatttgggttctttccacttttggctgctatgaataatgctgccatgaccatttgtgtacgactttttgtgtggatatatgttttgatttctcttagatatataactaggagtggaattgccgggttgaatttttttttttttatgggtagacttttctttttgagacagggtcttcctctgtcacccaggctggagtacaggggtacaataatagctcactgtagcctcagtcgcctgggctcaagtgatcctcttgcatcaacctcctgagtgggtagaactatgtgccaccacacccagctaatgttttttattttttttttcagtagagatgaggtctcactatgttgttgaggctatagatttttttaattattaatacaaagtagtcaacctgttgcaagcacagtgtcactagcaatatataagaacaatttcctaatattaaatattttacatgtgatgatatctgattacaacacttgataaattagtcacactgcaagctcttaatgcatttgtcttaacagccaaatatagaatgtgtgaaggcatccaacttatttcttgattattttgtatttggatagattttaatttaatcttcatgtaacttgatgccactctaaacttgacatgaatccaaaaagcttgaaagattcacaatgatagaaaattaaaacaactaattggtcaataatggagacattaaatgtgaatttttttctttttttctttttttttttttgagacagaatctcattttgttgcacatcctgaagtgcagtggtgtgataacagctcactgcagcttcagcctcctgggctcaagagatcctcccacctcagcctcccgagtacccaggaccacaagcatgcaccactatgcttgactattttttttaagagacaggttctcactatgttgcccaggctggtctcaaactcatgggctcaagtgatcctccacccatgctgggattacaggcatgagccatacatagcacccggccaattttttgtatttatctaaaagttgtattgcctcaagttttcaccagtttcctttttaatgcacagagcaagatttgggaagatcctaataacttactgttttgtgttgctttggagattttcagtatctatcagaaatcttcatatatttagcaataaacatgtattactttatcaagaatattcattgtcttaccttttttccaaggcagccaagtaacttcacattgaaaacgacaatgatctgtttacatgaccaagtgcttaaaaataaaaagtaagaaaattttaaaccacagcattaataaaagcaaaaacaaagtacagtgtattacctctgtattacagtcattgtctcttgacaatttaaaggctagagcacaacattctactccccgtttgacttttcacctgtctctatttttcagcatccaataaaaataagattgatgagaacacaagtacacttagtgttacatcttttactttcatttctgagatgccttaattccagagagcagaacctaaggctagggtttaaaacttacccacacgatatggggctattattttctactactatatattcttttttcttttctgcgttacctggttctcttagaattgatagttgtattgcctttattcagtatttacagagaaaattaacatttttgaaagttttaatcttcattataacctactggtcattatatgtctataacttagtagttatagactaatattactcacatgcagaaaaataaaacttaatctccattagaggaaacactaagtccttttgttctgaaactctactgtagctactgtagtataattgattttcaggggctctggaatcctctgtgttggcacagtcttactaaacacagaagttgggagccttctaagttcaggttcattgagaaatctccctctaaaagtgcagagaaagaaaccctataataaggattgcttatttaatctcatggcagaatgtcagagctgtcccacaaggttattattatgattttattaacattttggcctagaggatcttcattgccttctctcagactataataggtgttcttttccctcttagctaaattaattcataaacattacttcacatcaacataatttcaattcaacatttaaaatttattgttattcacacaatataagatataattaatttttttgttgttatatatttattcaagcaatagaatttcatcctgtaagtcaattactttttaggaattatagtttataagtaattaaattgaacataattacagtcctacattaattcaaatatgattatacctaattagtctcaagaaatgtttgtatttaaaagctactagaatttttttatgattttaaaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctggtaagtagcaacagactcagtatgagagtgtctctgtgcatgtggttgcattttaaatgcatgttgactaaataaaaacaatcaagatggctttttaaagtgcgttaaaatttgcagtacaaaaatagtacattatcattcaatctctcttaggggaagttcttcatttctttctgttccagaatatatataaaaatgaccaactagcttctttatatcttttattctcataatttcttcttcctttactttttcccctttgtcatgttcccctttaaatcatacaattaattatacttttatttgacagaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggtatgtaatgaccattcattgtaaaatgaaaacattgtgggaaagggctgatcatatattaggaaaaatgtttggaacatacttacttcttacattaatagtatcagagagaaatacacatctgtgtgtgtggtgtgtgtgtatccacacacatatataatgggattttaaaaaataaggtaataatgtaatccaaattcatgatacatggcaattttaagagttctcaattctactctccattttattgtgagtagattataatgggacaaggaggtgtcatttagttcaccactcctttattaagtgcctatcatgtgttcacactcttcagagtttctagaaccgccccatgaaacaaaatatgcccatgtaaggctagaaagagatgactgtagttttcatttccatagctgaaatggtcttggggcttgaggtaggctgatttttctattaaagaaaaggtctaacctgtgatcatattccctaaggttttgtgaaagtgtgttgcttgttattccgagtttaatataaatgtcattgtggatatcactatgttatctttgtacttactaatgttctactgataggagtttctcttaaaatttgtttctcccttaatcttccacctattaccagatcatacaaccatccactcaaaatctacaggtcattcctgattgccttctttccctacttccctgcgtcaaaacccatcaacaagtcctgtcagttctgcctacaaaatatgtccctattccatctacttctctgtttctgctgatacaacttgagttcaagctgccatcttctgttccctactccagtagcttcctaattggcctctatgcttctgttcttgaccacttggaatgcattctccaaatagcagctaaactgatattttttaaatgtaggttatactatatcacttccctaacttaaaaccctgtggtgacttcctctaatacttagaacaaaattcagatctcttgctgtggcctgcaaggacctatagtctggactctgctcacctctccaactggagttcatgccagtttctccctttctcatgatcctttagccactctggcctcctttttctccttgagcagaccacctgtcacattaccaaccttggtcttcgtcagtcaggtaccagctcaaatgtcatatcctgactagcccactacaactacttcattctgtattgcatttccttgttttgctttcttatagttcttactgctagtcctaattatgcatttgtttacttgcgtgtgatctttctactgttagaaaataagctccttatatgtcttgatgatgtatctccagcctctggtacataggtacactcaccaaatgtttgaagtgactgctctgttcttaacaaattagttttataatacaaatcagctacatattaatataagtcatattacaatcttatgtaattccttttttttttttttttgagacagaatcttgctctgtcacccaggctggagtgcagtggcaagatctcggctcactgcaagctccgcctcctgggttcaggccattctcctgcctcagcctcccgagtagatgggactacaggtgtccgccaccatgcccagctaatttttttgtatttttagtagagatggggtttcaccatgttagccaggatggtctggatctcctgacctcatgatccacctgcctcggcctcccaaagtgctgggattacaggcgtgagccaccgtgcccggccgaattctactgtcttatcagacttgcctaaatgcagaatatctgtagattttcaatcaacatgaaaatacgcatacattaaagttttaacttcatgtaagggctaaaggtttatagttatagctagatattaacacatttattaacataagtgtaataactaattattggtggtatgatgtaaattatattaattaaggcatctaagatagtacatttactagtggcatattttctatcttctcacggttattaggagagcatagtgattaagaggatgaactatagccagaatgcctgggttcaaagtcttgctctagcacttgcaaacattgtcacattagacaagtaacaaccactcaggttggatttttgttttactttttattccaacaacaaaatgaggctaataataatgtgatgattgtaagaatcaatatttataaaatacatagaactgtgcctggcacatagcaaatgttatataagtatgactattaccactattacagattcagcagtctaatccaaaaatctgaaatctaaaatactccaaaatccaaaactttctgagtgttaacatgatgctcaaaggaaatgcttattggggtatttcagattttgaatttatggattagggatcttcaactagtacgtatttgcaaatattccaaaatctgaaaaatatctgaaatccaacacttctggtccctagcattttggataagggatactcaacagatattatgatgactattgtccaaactcctttcatcaagtagaagcacaggctagaccaaggagatctggagtatgatggatgactctacagaccagctggagtagtccaggagatcagagagtcccagggacccagacagtagccttggcatataagcaaaacacagcctggcagatttcagcaagcaaagagttggtatcaaaaaggtcttgctatgtttcatattttgttggagaaatgaagatcctatatgtgggcaaaattcaaagacagggatgctggcctagggagcaagacagggttgtaactaccagaagttagaaaggagggagagctggatcctagtggtgagaaggagcgcactcagaatctacaacttggatcgaggaacagatcaagactggcaacgaggctgacttgataccaagctgctgagctctcagttcaattctcatactctcccagataggagcagagtttgtcccagagcttggagtgggtctcatctgtggaaacaactctcttgagttgcaatattagaacgatacaaaatattttgtttcattagaacttcagttgaggacagaacatatgtaacatgaatcacaagtttgatttaatacaacagctttctccttgaggatctacagtgccaggccctgggcttgctctgggggatccagagacagataagacacaatcaactcattaaaagctcaatccttcagtctagcagggaaatttctgtggtcgtgtggggtagaagaatctaatttcatctgttgtcagaatcattctcctaccatatgtgattatttctggttctatactagaggcacagctaaaatcctcaacagctgatcctgaatttcagggagcttatgaaaggaaggccctaatcaacctagtgtatattataaaatgggttttgaagtctcagttgccactgtctccccaccccccgccttattttaactaactcattgaccttgggcaaactactgatctttttgagcttcagtttcctcaactgaacattggagttgatgttatctacctttcacagttgtcgtggagtattatatctaatacacttaaataaataaatgcattacacatagtgagctcttaataagggcttgtttcctcccctccgctttttcttatcacacaaatgcctagaccactaaaaaagactcctagatggaattccaggctccagtatctcttccttccagcctgtccttctaagtttttagaggaacaaatagattgtataattccctgaagaaaaccttcagtggctctgttactctgccagactgaccttgagagcccggcataaactgcccccatcccccaattttgccttgcagtcccttagacatggtctgtcctctatcaaactggcctatctggcattccccaaaccaacctataacatcctgcttcctcttcatttgaatccctcccatctctgccagctgaattcctccccacacttcagaagagctaaaatgccatgtagtcaatgaagcctttcctagatgccatgttcaaacatgataaagccctcctctgaaatcttgtagcacttcatggtactacttttatgctatttttcactgtattcctcacacttgaacttatgtgtccccatcttgtgtctctcctagattgtatgtctgtaaaggaagaggttgtatctaatttgtcatcatgtcctttacagcagggtcccccagcccatggcctgttaggaaccaggccacacagcagaaggtgagtggcaggcaagcattcccacctgagctctgcctcccaatctaatgagcaggggcattacattttcatatgagcgcaaaccctattgtgaactgcgcatgtgagggatctaggttgtggactctttatgagaatctaaccaatgcctgatcatctgaagtggaacagttttatcccaaaatcatctccccaccccttggtctatggaaaaattgtcttctatgaaaccggtccctggtgccaaaaagattggggaccactgctttacagtatccatcgcagtagagatgttcaataaatatgttgactggataaacgaatccatgaacttccgtgttctgtttcatatcattcaaaagtattacattatatatcactattttatggaacgaatgaatgtgttttgattttctacaccaaactatatcagggtgcgttgtgttatttttcagtggtatcatctgtacacacagtctaatgtcattacattactcaacctctttgtgatatcattgaatagtctgccaagcttacctgctcccttaaacagtagctaattcttaaatacagagatatattaatctccttaggtttagtcctcaaaacagaattgagtttagatgactttttccttcaagaccatttaattcacttaaaaattggccttatagagttggcttataatacagaagcctcagatttgtctctttatattcctcattccatgattgttgatgagatttataaacaaactccccatatcactttatggaatttattttgtaattgtaatgaaaaatataaacatgaaaaacatgtctataataataaatcaaactaatcataggttctgaataaaaacctcaaaagtaatgttcctagaatgcaaaagcttattttatggtcagcttataattttatcatgtgaacttttaaatgttagtagtatatttagatctcaataaaattagcatctgttagataaagtaatgccaccaacctaggagtgttgtgcagtttaaatgggtctcaataaaagaaatttctggcactgtatatggcacatagtaggttttcctctctcctaatcctcctgtgtgcactgcctattgaggattccattttggaaatgcatatgttcccagattataaatactcaatccattttttggtagtaaaattggtaatgggtattttaattcctatacagatctgtcatggttcttggccattgtcacatgccaaatgaagatatctaaaagtttatggcaacatataaatgaaaataaatatgaaaacaagaagaatacaatgataagggaacaggaacaaattcttaagattgaaaatgccttttttaatcgagaaagtgttagccacacctggctaatttttgtatttttagtagagatggggcttcaccatgttggccaggctggtctcgaactcccgacctcaagtgatctgcccgccttggcctcccaaagtgctgggattacaggcatgagccaccaaaaattctattatttataagttacccagtatgaagtattttattatagcagcataaactttctaagacacagagagaacctaaatggtagagatctctgttatttttgctccagtgggcatttctgatcacttgtgtgttttgcacccagcactgtgctgggtactttacatacataataactcattaaatttaattttactccatgaggtgggcctcattcccattttacaagtaggaaaactgaggccaagaaaaagttaattaactggttgtgaatcacaaaatttataagtgagggagccaaaatttaatccccagtctttctgactataaaacctgtttttttcacttatatgtaaaaaattgagatgatacattagaatgacagtgagccacctcactgagaaatgtggaaagaaggaaaatagaattatccttttacttcaaatgttaaatcatgaaataatgagttagacaaagatatgcaaagtaactttaagtcaataaaaagactgccaaacacacaagatggattgggtattgtattagtctgttttcacactgctgataaagacatacccaagactggccaatttacaaaagaaagaggtttattggacttacagttccacatggctggggaggcctcaatatcatggcagaagacaaaaaggagcaagtcacatcttacatggatggcagcaggcaaagagagagcttgtgcaaagaaacgcctgtatttaaaaccatcagatcttgtgagacccattcactatcacaagaatagcatgagaaagacctgccccctgattcattcatctcccactggttccctcccacaacacgtgggaattatgggagttacaagatgagatttgggtggggacacagagccaaacagtatcaggttttaagatagctaaagaaaaaacttttcctttaggaagatgactagtcagctctggagcccaggagggtcacagaaatatttgttggaatagatcttcctggcagcaaccaaagaaatggtgcctaagagtctggttcacctggtagctaaatcccctttatggaaatgaatgtagcagctgtcaaatctctatgtctaacattcaaatcatgtaaccacctaaatatccttctaatagtttggctcccagtgtagtctgtctacatggagaaagtatatcatacactggttgagccaacatcagtatccagactgcttggcagttatacatctcatggtaacttaataacataacttggcattttgtttatatgtcagtctctagtgaactttgttagcatgagtcagcattcctaagtctagtcagtgctagaataccactgaaattttctgagactctaggaccaatggctagatcttgaatgatggttaatccatcacattaaatgcccttttcattaaatgcccctcccagcaggttggcctttccctgatgacatctctgttcaatatgtcacaaaccttttcaaacaaatgtctattctcactaccttaagagttatgaggagtggggataatgtgtgtggagcatttagcgtaatgccttacatagttgaagacccaatcaattattatgacacatcataaatggtagctgttaccatcattatcttctttcccatatcaattgatcaaagaatctgggattctaatgtgttagaccacattagacagacaaagccctgttttctgagaaggaggtttttgtgtttatagtctgttaatgtcgtaataattgttagggatgctggctctgtgtgtgattgatgaatgctttcattgagagcaactgctgtaagagacactatcttccccacagttatggttagtggactctggtagtatgtcgactacagttctttaggttgcaggtagcagaaaccccactgaagttagcttaagctaaaatgagggggattaatatcaagatacagtgggcagtcctggaaacaattgcaaattgcagcagggcctctggaagaactggggccaggaatggaagataggaacccaggggaatattcactcgctattgctttttctctttttctttccccgtatttgctttattcttccctttcaacagactttttttttctccctttcttcttaggccacccagtactttccccacagcttccagagctccaaaagtcacatttacaagtccagcctctgtttcagatccacattcgtaatttaccaagtttgatatcaggtgctcttggcccagtcaactttggtcatggggagagccacgttttaccaacacggctgaatttggggtcattgtgagctttacagaaatttcccaggggatctattttatgtcacatctctcttactgctcttgctttccaccctggctatattgggcaaactcatggtttgtgttgacctctcactgacaaaaattgactcaattttgctgtggtttttccagcttttccctttgcaaatatctggaaaagacattctgctctgcacatcaaaggctatctgcatctggagaaaagccttacaccatttttaaatcctgtcgctgtcttcccctagtatcctctcaaaatgtaggttaggcaaggtcctttgtcttacagacacacatgagatagtttcttatctccagtgtgcttaagatcaatacctttcttgactagtgcttgctttttagtgcaatgactatgtaatacattggcaacttcacagattctatagtcttccagttctaatgaagtatgagagctttacatataaagtaattttctttttttgaaattgagtttacaatgtaatgtttaatgtctgtagcttgatggtgatttcattgtgtttagttttctaataatattttatctactacttgtccacagactgaactaaagcttcattaaatcttatagttgtgtggggtttttgtctttttcataattacatggaaaatgttctgagtcagatagtaatagtcagtattatccaataaagtagaaactagacttttgctgctttaaatttgactttacaagcttcccgtaattttgaagcacctggacctgataggcaaaggttatgatattagcacatgatggcactacaaaaagagaatccttctgagagttatttgcaattgaatatgatttgcctcttccacacatagcttaaaaagaataaaaggaagtgttcttggatgtttcttttcagctgggttgggcagttcacttatagctgcacatatgttcccagaatcctgagcctttttataagcacctcctgcccactggcagctgtactaatgtgtcccagaaggctttgctcctatccatcatctttaggagggatgctcaaagccagatatgaaattcattgttgttgaaatgcagaaaggaaaataaaaaggcctgggggctttggggaagtaggaggttgagccagactcttaggaaataaaggaaaggaacaagtcttgtgtatccagtggacacaataataaatgtttttgaatgatgggtaacggtgctggatcaactgctaagtgttttgcttccagaagccattgcctcctttttttagacaaagaaaaatctaaaatagagtgttccctgaatacacttttaatcattctgtcttcataatgttgtaaaagtatgaaaaaaagatctaggaatacattaaaaagagccctgcctgagatttttgagattaactcagtaaatacagatgaaaggacctgggctaaatgctgagagagagacacaaaagtggagagggctctagctcttctctcctgaaaggtacctgtaggtacaggtacaggtacctcctgaaaggtacctgtaggtacaggtacaggtacctcctgaaaggtacctgtaggtacaggtacaggtacctcctgaagggtacctgtaggtacaggtacaggtacctcctgaagggtacctgtagtctttcaggagggacaagtacataaaacatgacagggcagaacctgtgacatgccacgaaaaagccacagagaatctgcctttttaaacgaagcttacatttgaattgagacatcaagacaaggcttcatggaggagatggttactgaggtgatccttgaaggatgaagaggattaaaactgaaaaaaaatggagtgaagttgtatataaagaagaactcagtgagcaaaatttcagaactggatagagagggcagaacatatttctgggaagtggcaaatcatctggtttgactagcacaggttagacaagtatgggattagtggaagagtgagtgagaggccgcagatgtggcttcttaatctccattcattccatggtgggaaaagagaaggaaactcattttttgagcacctagtatgtaccaagcaccaaacttgtcattttatatgtgatatcccttctatcttccctctaaccttgtatgtaccattatcttcactataaccctgtgtggtatgtactgtttagagctaaggtaaatgaggttctgagaaaaataattttcccaagatcataaagcaagttaagggagtaaaaccaggattcaaatctcagtttgtcgatttcataattctttcatctttgttgtgctaccttgactacatttagagtgtggggtttatatttcatttgataggcattggagaaccactggcagtccagagctttggaaacattagtagtcttgtggaggtgaaatgaatcaggagagaccagaataagaagacctggtaagggtcttagagagatgagaggctgcaacctgaagggagtagtggggaaggagaaaaagaaatgaatgcaagagaggttatagagaagaaatctatgttcttgacaactaatatggtaatttaatgaggaagtaagagaagtcaaggtaattgcaagatttaagctcagtgggatgtgtggcaaaagcattcacacaattttggaaataaagaggagtgcctgctatgctaggcactattcactttgtgaggtgctttacacacattctatctaagcctgaatcaaccctgcagagaaagtgttgctatccccctattacaatgaagaagctgaggatctgaaaagttaaatgggggacctcctctccctgagcagtgcatgaattaacaagagatttaacatacaatttcaggaagtttatagacccccctataagccatgaaagagtctctcgtgaagaatcacaagaacataagagacactgctggggcttttcagctctatgtcaattagtattaggtttagatatgaaagacagaaaatatgcaataccagtagcttaggtaaaatagaagtttatttcctttcacacatgggaacagtctggaggttagtgatctaggactgcgaatgtctctacgaagtcatgaggacccatcttcctgctgtatgctactctgccatccccagcaccctttccttcatggtccaagatggctgtagaagcttcaagcatcttgttcctgctccagccacaagaataggaaaggaccaaaacagagcatgcctccccgctttatggatatgccttggaacccacacactgtcctgctgtgctgctaacatcccagagcccagaattttgtcacatggccacaccaagttaaaagggaaatggggctcgtttgcagaggaagaaagaaagaggagatattgggagacaacatcagccctgctggcatcacagccataacaccaaggaactgtccacagtctctccacccacccagtaaactgcttctcatcttgcctgattgtgagcttctttgtctagtctatggtgcagtaagaaaactcgctttccagttcattaacgaaaggtctgccaaggcagaatttgtagataacacttaagaagcaaatgggattttcgaaacaaaaaataataataaatagtttgaaatgctagcattccttgcccttcaaaaaagtaagaggtggggaaggaatttgtcagtaagacgtgcttttaaagtaaatggaaaacatttgcaaactggaagaatactgaagtcatttttatcctgtcactttatttggtggtagaaattttattagcctatttctcttttcctattaaatactctcacatttaaaagggggaggggagcatttctcaaaatgaagaactatgtttagcaatcagtgtgtttgatgttcactgctcagtattaaaaatgtttggggtgtaaaaaatgaaagaatagtaaatatgaattgatggtctggtaccatcttttatgacttggtctctgtcaaatagaagtatttgcctcctatgagattcacaataaaaaccattatccattaagcatagatcatttcttgggagctacattgttgaagagaacagcaaacagaaggaaagagggaagtacagaaaaacaatgtcgtccagctgttaagagcacagattctggagctaaagtctctgagtccaaatccaaggtcagctggtgatctcgggcaagttatgtaaagtaacttcttagtacttcagctttcacatctgcaaattagggataatcatagctcatgcctcattcagttgttaggaggaataaatgactgttggatgtaaaaaaatatgtagaacagtgtctagcacatagtgctgaataaatgttagcaattattatgttctgctaagggcttatcatctgcaggtgctaatttgcctcttgttctgtcctagattttgaatcttggaggaaatctgagttttgattgcaagctacaaattctttacctctttatctgtcctttccataaagatattggaaaaaaaatttatttttgtcaagcacacatggcttccaattttaaaaattcaatacctagttaaaaaaaatgaaactttattaccttagatgttttctagcaacatttttaaatgctacgtcaaagttaaaggtcttggttctcttatgctttttagcagcaacctttttagcagctttattgagatataattcacacatcatacaattccctaatttaaatagtataattcagtgattttaatatattcatgaagttgtgaagtcctcaccagaatcaattttggaatatttttatcacctcaaaaagaaacttaggactctttagctttcaccttctggtcttcccaacccccagccctaagtaatcacgaatctactttctgtctctatatatctgcctattctggacatttcacataagtggaatcatataaatatagtttttttgtgactggcttctgtcatttagcatgttattttcacagttcatccatgtcgtatcatgtatctgtacttcattcctttctgttgccaaatgatattgctttatatggatataccacattttgcttatccattcatcagctgatggacatttgagtgtttgaactttttgaatccttatttactttacttagactctgttgtatccaacaaacttgaggggaagaccaaaagatgatgatgatgattaatcatatttacaaggtactcttaatgtacattttctcaaaaagcttaaaatctaagcttcatgaaacaaatagattggcaataattacccagcaaaatacagtaagtgttataactaaaggcagggatgggagttgatataataggagatgggtgtgaaaagtagacttaaagcatgatagtggagggttttaagtgcttgctgagacacttgggctttattccataaataagcactttattctgtgaaggtagtcattaaggctattgagctgagcaatgaccatgaccaattacagaggaaaggatgaatcaggacatactatatattggatgcatagacaactgttcagagcacattataattactcacaagtaataagaatgacagttggaatgggaaggaggaaatgaatgtaagatggagacatctggaggcagaataaacagatttcaatgcccggatgtgtatggtaatgggaagggaaaattaaagatgaccctattctaaatgactagatggatggaaaaccattaatggggactggaaatgtcagaagaaaaatggagcagccaggactatggaagagataataggttctacattggacatttaaaatttaaggttttggaggaataatcgtagtaaatgccactagaagtttggacatgtgggctgataattcggagaagagggagacttatttaagaaatggtttggggaattatcttcatggaagtgaaaagtgaagccaagaaagcaaaatagaagtcacactcagaaaaagtaaagagttcaaagactagagagatgagaatagaaccatgaaaaaactcattgtatctagtaaataaatagtagatgagtaattttaatgggttgaacagtttcccctcccaaattcatttctacctggaacctcagagtgtgactttatttggaagtagggtttttgcagatgtaattaagttgtgatgaggtcagactcgattagagtgggctgtaatccaacaagcagtatcccttataagacaaaggaaatttggacagagacacagacacacagaggggaagaccatgtgcagagggaggcagagactggaatgtcgcaactacaagccaaggaacacctgggattgctgggagccaccagaaactaggaagagacaaggaagggggtcttctctattgccttcagagggaatatggccctactgacacctcagtttcagacttctaaactccagaactgccagaaaataaatctcaattgttttaagccagtaagtgtgtggtaatttttcatggaagccctaggaaactaatacaggaatcaacaaaggagtggtcaaaaaggaaggccgtggaggcaacagtgtcaggaaagcccaggcatagtgaaaatctcaggaagtttacagagctcagtggtatcacgtctgcagaaagagtatattatggactggggggtggaaaacgctgcgaatttgacaacttccagatcaccactgacttgaagagatcaattttagttgccagagcaccatgtagagccctttgaatagcccatctccctcttgtgttctctgcgcttgggtcgcagtgggcttaattgtttgaaatcctcaatacactgttaagttccatagcagtagagtaatggtaaaaacatttgttttttaccaatgtttccctgttgtctagagactggaacgtagcaattgctcagtatgtgtggaaaggattgaaggatggagagaagaagtgaggaactagaaagttacgaatttagtttacacttgattttaggacatggagggggttgtttttaggaggggttataggtagagagttgagtgctaagattctctccttagaggtggagaaattagaggtaaaaataacagtttaggctgggcgcggtggctctcgcctgtaatctcagcactttgggaggctgaggcgggtggatcatttgaggtcaggagttcgagactagcctggtcaacatggtgaaaccccgtctctactaaaaatatgaaaagttagctgggtgtggtggcacgtgcctgtagtcccagttactcaggaggctgaggcaggagaatcacttgaaatcaggaggcagatgttgcagtgagctggatcacaccactgcattccagtctaggcgacagagcgagactcttgactccaaacaaacaaaaacaacaacaacaaaaatcagtttaaaagaagaaaaaaaatagtgaggtgacaaggcctaaatgagagtttgagctatattcatgtgctattgtactgtagcccacaaaccttgacacaaacttggaaaaaaaccctaagacttcaggactgaaagatgtagttttttacttattttatatttttgcctccatgtattttcttatctagtgtcagacattacgctgagagctttatgtaataatctcgttcagtcctcatgctacaaaaatgtatcattcttattttataaaaactgttaccattcttattttacagatgagaaagctaagcccagagaggttaaataattttcccaagggcattccattggtaaatagcaaagctgagattctatcaggcattctgattattgaacctacaactcttaactgcagggatggatatatacttgtagtttaatgaaaaattctgtcctattgaatttgaagtgtttcaggaaagcctttgaagatgtccttcttttttttttttttttttttttttttttttttgagacagagtctcgctctgtcgcccaggctggagtgcaggggcgcgatctctgctcactgcaagctccgcctcccgggttcatgccattctcctgcctcagcctcccaagtagctgggattacaggtgcccgccaccacgcccggctaattttttgtattttcagtagagacggggtttcaccgtgttagccaggatggtctcaatctcctgacctcgggatccgcctgcctcggcctcccaaatacactttcacatatgatcagtgcttcttaaatttttccagtctgtagatgtggtgatagggtcccaaagcagcagccttcccccacaagcataatatttttgaaatcacctcttgttttccatccaaattctatattttgctctactatgcatttttattagttttactcttataaaatagttttctaatttctatttcattacctgtactattagttaatggagagatcctgttgcatttataaaattaaaccaaaagcgtgtatcagacagttttctctaccttggtgccacaatattttgaaaacctagagttatacaaataagtaattacagatggcaaccatttttttcactgctttatcagccacatagtggtgaatcactgagaagagatattcagaatgctgctaaagcagctaaatcatatgttggttttagactactattggaaggaatttggtaagtgtgttttcttgttaacagttctcttgtatcatatcttaggctggaatggttgcttattcaatatatgatataggagacagcctcttttaactatctgaaggaaatacccaccaaagggcatttccagtgaagagagatgaccaatttggttgtgctctactttggggagtctcactatatataagctgaaccctgattctcaaaggactcgttatcactacaactagctctcttaagaccgctctcagacttcattttattgcagtgatctggaaacatacataagagtacattcacagttttatctatatttgttgattgaaaattattcagcgttgcagaaatatttgctaagtcaactttaaaccatttttcaaaaatgactaatgatttcattaatcttacatacatttttaaccctttatcatgacaccttttttgtttttaattctccatgaggaaaagccatttcaatgcaaattccaaacaccaactactatcttttttctctttagctaaatcatggtatatctgtataatataacaagctttcagagttcctttctacttcattagaaattatcttaaaagatgggtactcaaattactgaattttttctctttcttaaaacattcttttgaacacattaagaaaattcagagcttaaccttgatgtaagctacttttagtaatcgtgtattcagaatgaaagatggtcttgaagaatcaacgttttcacagtttatcctattgtagatttgactccttctacacatacaaccttacatttttttccaggcaatatctttatctctctaaagtctatataccgtgttgaaaatcttcagttattttaccattgagtataaaatataccttcataaataccatcatattaatacaatcaacatagaccaataaaataatttactaatgtttagtgctagtgctatcatctagtggtaagttaaagaacctgtctatcgagggtggagccaagatggctgaataggaacagctccagtctagagctcccagcatgagcaacacagaagatgggtgatttctgcatttccaactgaggtaccaggttcatctcactggggagtgttggaaagtgggtgcaggacagtgggtgcagcgcattgagcctgagccaaagcagggcgaggcatcgcctcacccaggaagcgcaaggggtcagggaataccctttcctagtcaaagaaaggggtgacagacggcacctggaaaatcaggtcactcccaccctaatactgtgcttttccaatggtcttagcaaacggcacaccaggagattacatcccgtacctggctcggagggtcccatacccgtggagcctcgctcattgctagcacagcagtctgagatcaaactgcaaggaggcagtgaggctgggggaggggcgcccgccattgctgaggcttgagtaggtaaacaaagtggcctggaagctcgaacttggtggagcccaccgcagctcaaggaggcctgcctgcctctgtagactccacctctgggggcagggcatagccaaacaaaaggcagccgaaacctctgcagacttaaatgtccctgtctgacagctttgaagagagtagtggttctccctgcacacagccagatatctgagaatggacagactgcctcctcaagtgtgtccctgaccccagagtagcctaactgggaggcacccccaagtggggcagactgacacctcacacggccaggtactcctctgagacaaaacttccagaggaaagatcacgcagcaacatttgctgttcaccaatatccaccgttctgcagcctccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccaaaatcaaagaccaaaggtagataaaaccacaaagatgtggaaaaaacagagcagaaaaactggaaactctaaaaatcggagcaccactcctcctccaaaggaacgcagctcctcaccagcaacagaacaaagctagatggagaatgagtttgacgagttgagagaagaaggcttcagacgatcaaactactccaagctaaaggaggaagtacgaacccatggcacagaagctaaaaaccttgcaaaaaaaattagacgaatggctaactagaataaccaatgcagagaagtccttaaaggacctgacggagctgcaaaccacagcacaagaactacatgaggaatgcacaagcctcggtagctgattcgatcaactggaagaaagggtatcagtgatggaagatcaaatgaatgaaatgaagtgagaagagaagtttagagaaaaaagaataaaaagaaatgaacaaagcctccaaaaattatgggactctgtgaaaagaccaaatctacgtctgactggtgtacctaaaagtgacggggagaatggaaccaagttggaaaacaccctgcaggatattatccaggagaacttccccaatctagcaaggcaggccaacattcaaattcaggaaatacagagaacgccacaaagatactcctcgagaagagcaactccaagacacataattgtcagattcaccaaagttgaaacaatggaaaaaatgttaagggcagccagagagaaaggtcagattactcacaaagggaaacccatcatgctaacagctgatctctcagcagaaactctacatgccagaagagagtgggggccaatattcaacattcttaaagaaaagaattttgaacccagaatttcatatccagccaaactaagcttcataagtgaaggagaaatagaatactatacagacaagcaaatgctgagagattttgtcaccaccaggcctgccctaaaagagctcctgaaggaagcactaaacatggaaaggaacaaccagtaccagccactgcaaaatcatgccaaattgtaaagaccatcgaggctaggaagaaactgcatcaactaacaagcaaaataaccagctaacatcataatgacaggatcaaattcacacataacaatattaaccttaaatgtaaatgggctaaatgctccaattaaaagaaacagactggcaaattggataaagagtcaagacccatcactgtgctgtattcaggaagcccatctcatgtgcagagacacagataggctcaaaataaagggatagaggaagatctaccaagcaaatggaaaacaaaaaaaggcaagggttgcaatcctagtctctgataaaacagactttaaaccaacaaagatcaaaggacacaaagaaggccattacataatggtaaagggatcaattcaacaagaagagctaactatcctaaatatatatgcacccaatacaggagcacccagattcataaagcaagtccttagagacctacaaagagacttagattcccacacaatagtaatgggagactttaacaccccactgtcaacattagacagatcaaccagacagaaagttaacaaggatatccaggaattgaactcagctgtgcaccaagcggacctaatagacatctacagaactctccaccccaaatcaacagaatatacattcttttcagcaccacaccacacctattccaaaattgaccacatagttggaagtaaagcacccctcagcaaatggaaaagaacagaaattataacaaactgtctctcagaccacagtgcaatcaaactagaactcaggattaagaaactcactcaaaaccactcaactacatggaaagtgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaggcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcagaaaatcaatgaatccaggagctggtcttttgaaacgatcaacaaaattgatagaccactagcaagactaataaagaagaaaagagagaagaatcaaatagactcaatgaaaaatgatgaaggggacatcaccaccgatcccacagaaatacaaactaccatcagagaatactataaacacctctacgcaaataaactagaaaatctagaagaaatggataaattcctcgacacatacaccctcccaagactaaaccaggaagaagttgaatctctgaatagaccaataacaggctctgaaattgaggcaataattaatagcttagcaaccaaaaagagtccaggaccagatggattcacagccgaattctaccagaggtacaaggaggagctggtaccattccttctgaaactattccaatcaatagaaaaacagaggatcctccctaactcattttatgaggccagcatcatcctgataccaaagcctggcagagacacaaccaaaagagagaattttagaccaatatccctgatgaacattgatgcaaaaatcctcaataaaatactggcaaaccgtatccagcagcacatcaaaaagcttatccaccatgatcaagtgggcttcatccctgggatgcaaggctggttcaacatacgcaaatcaataaatgtaatccagcatataaacagtaccaatgacaaaaaccatatgattatctcaatagatgcagaaaaggcctttgacaaaattcaacaacccttcacgccaaaaactctcaataaattaggtattgatgggacgtatctcaaaataataagagctatctatgacaaacccacagccaatatcatactgaatgggcaaaaactggaagcactctgtttgaaaactggcacaagacagggatgccctctctcaccactcctattcaacataatgttggaagttctggccagggcaatcaggcaggagaaggaaataaagggtattcaattaggaaaagaggaagtcaaattgtccctgtttgcaggcgacatgattgtatatctagaaaaccccattatctcagcccaaaatctccttaagctgataggcaacttcagcaaagtctcacgatacaaaatcactgtgcaaaaatcacaagcattcttatacaccaataacagacaaacagccaaatcatgagtgagctcccattcacaattgcttcaaagagaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaacaacaaagctggaggtatcacgctacctgacttcaaactatactacaaggctacagtaaccaaaacagcatggtactggttccaaaatagagatacagaccaatggaacagaacagaaccctcagaaataatgcagcagcgtacctacaaccatctgatctttgacaaacctgacaaaaacaagcaatggggaaaggattccctatttaataaatggtgctgggaaaactggctagccatatgtagaaagctgaaactcaatcccttccttacaccttatacaaaaattaattcaagatggattaaagacttacatgttagacctaaaaccataaaaacccagaagaaaacctaggcaataccattcaggacataggcatgggcaaggacttcatgtctaaaacaccaaaagcaatggcaacaaaagccaaaattgacaaatgggatctaattaaactaaagagcttctgcacaacaaaagaaactaccatcagagtgaacaggcaacctacaaaatgggagacaatttttgcaatctactcatctgacaaagggctaatatccagaatctacaaagaactcagacaaatttacaagaaaaaaaacccatcaaaaagtgggtgaaggatatgaacagacgcttctcgaaagaagacatttatgcagccaaaagacacatgaaaaaatgctcatcatcactggccatcagagaaatgcaaatcaaaaccacagtgagataccatctcacaccagctagaatggtgatcattaaaaagtcaggaaacaaacaggtgctggagaggatgtggagaaataggaacacttttacactgttggtgggactgtaaactagttcaaccattgtggaagtcaatgtggcgattcctcagggatctagaactagaaataccatttgacccagccatcccgttactgggtatatacccaaaggattataaatcatgctgctataaagacacatgcacacgtatatttattgcggcactattcacaatagcaaagacttggaaccaacccagatgtccaacaatgatagactggattaagaaaatgtggcacgtatacaccatggaatactatgcagccataaaaaatgatgagttcatgtcctttgtagggacatggatgaagctggaaaccatcattctcagcaaactgtctcaagaacaaaaaaccaaacactgcatattctcactcataggtgggaattgaacaatgagaatacatggacacaggaaggggaacatcacacaccggggcctgttgtggggtggggggaagggggagggatagcattaggagatacacccaatgttaaatgacgagttaatgggtgcagcacaccaacatggcacatgtatacatatgtaactaacctgcacaatgtgcacatgtaccctaaaacttaaagtataataaaaaaaaaagaacctatcagttttttcaagtatgtattttgaatacattaaaatatatcatttgatagcatgtaataggcatggccctttttgttttagcttttaggctgcctctttttacttttttctttttttgattcaatacaaatttggccttttctaagttatgtggatttagtttgatcaaaattacttctgtcatataaactccaccttccaaaaagtgatttgtaaactgatcttgaagaacttcaagtaatttttttggaagtttcttgttctatatgtgtcctattttattcttcaaactgagacttctatcattcagtcaattttagttgaaaaaaattctgatgatttccctaaaaaaatttttctattatgaaaaatttcaaataaataatctccctttatccatggtttcactttctgtggtttcactttccacagtttcatttacccataggtgagtacagtacaataagatattttgagagagagagaccatattaacataacttttattacagtgtatattaatcttttgctgagcataatttataaattaaactttatcataggtatgcatgtatagaaaagaacatatatagtgtgtatatatacagagagagttcaatactatctgcagtttgagtcatccactgggggtcttggaatgtatccctcatggataaggaaggactactctatatagaagtagagagattagtgtaattagtgtaataaactctgagtctaacccatctttagtaattatcagtatcttgtcctagttacatctgttctccactttttgttgatgttgttattgtttttctggaatattttaaaagaagtctcagctatatcattttatccatattatcagagccaacaaaaaattaacaataattccttaatatcatattatactctatctatatttttcccctattgtctcacaaatctgtgtttagatttggtttgtttgaataaggatcccgctgaggtccacacattatattagttgatatgtttcttaagtctcttttaatcagtaagagtccccttttatcccccttatgccgtttacttattgaagaaattggattatttggcctgtaaattttcccactttctggattgtggcccactctgtctttataatatcgtttaacatgtttatctattcccccatatcttctgtaatctagtcatcttatagagcttgattagatttgaactggattttttggaaagaatacttctcaggtgacagaataatattattcctattgtatcacaacaggaggcaagagatgtctgcttatttcacttttagcaatgttaaaattgatcaggtagtattagtctggcccatcattataaattcccccatgaatattttacatgtggttttagcatccattgatgtgtactatggtttgtcagcaatttccccaactcacaggatttaaatttagtcatttaaattcctccactaggaaggaggaggcatcctgccgttattgagcaagttctgtgcgccagaaattctgcttaacagtttacctacattctgtgctttgctcttcccaaatcttgcgcattccatacatcatagtagtttaataggaaaggaaactgcgaatagagagattaatctgttcaagatcatgtagctagtaagtgagcccagttctgcaggtttggagggttgttttatgaaaaattaacctggaaaatattaattctcatttatatgtagaagtgagtaaactagattaaaagtaaagaccaaactgaatggaatcaacaacatctgtagcatttgtactgccatcaataaagcaatgctaatgttatacatgcttagtacttcccttgccccaattctggaccattggagcctagcaaataatttatttcagtgataaatatccctttaatggaccaaaaatgtaagatgtatgtattttaaggaacaccatgacgtccaccaaataacatttttataaaatgaaaaactgtatcacaaagcattttctataagtctttaaacatcatttgttttcaaggtttggatttagtcttgttcagagcagcaagctgatgtctatatgacctcccaaagtcctttccagtcctgtgattctcacactaatgaattgaaacagaaaaggattattgggccagaacttggagagtcttcagagccagaatgtagaaaaagttacaaaatacagatgtctgtcagggatgggatccaaagagaaaagcaggccagaagttagaaatagatatgttattgtacaaaaaaaaaaaaaagttttaattttggcttttaaccagaataatttttttaaatattcagataaagctattaagctataatatccagttgagagacagtgaagtcctgtgattaaggatatataggtgaaaaaattcataattctttacattcaagtgaatacagaccagctgttggttcttcagacctgtgccagattgtaccttttagagaatctataatcttatatttttcattcagaagtaaaatcattctgatgccctttggaattgtcagtgttgcatatcaagaattataaatagaaataaaaacctttaaaatattgtataattatgtgagatatggcaaaaatgtttatactttttaacccaaaaagtaagccattatttttattgttttgttgtttattgttctattgaggaaaaagcctcttaaattaatgccattcattttaattgcatactaaacttgggagaatttgttatattagggagattttgttctttctgaggttttttgttttgttttaacttttcaaagggtatcttgttccaagaatacttttttttttctcttgggcggcagggtcaggagaagaggatcagagtaggcaacaactgagaaggttcctgattgactattctgtgtggatgtaagacctagtctatgggcaccactggttgttggatctgtgttgttgtcgtttatccatccatacaattttttagttttctgttttacatctttatttttgtaaactttcatgaatctcaagagaaaaatttgccacctataacctgtaatgtatcccctaaatagctaattaggtgtctatggcttttattctaccctataatgtgttatgaatttaactaaattgtctaaaaagcactccccaaactcatcttttccacattacattctttctacctgatgatccacgtaacaggacacaggttaccaccaaataatagtggtcagtgcagccagaaattctatctgcaaattcctgaattaagagccagtctttctagcccaggaaatttgcctctctgtagattttctaagggttgattttgcaagacttagaaaattatagattctttgagaggcttctttgttcccttagccacctgaaacctaaaaacaactaaatgaacagatgtatggtttgatatgttcagttgatatgtaaatagacatatttttgaaaatcctgtggctgctcttatgggaaatcaggtatgtataaggttaagagtgattggtgctaaactattatatgtcattatttcaagcaaatttgacatgacagacagtaggaaagaagaacatgatcaatgtcaaagacattcatgtttccttgtaatggtatatgtcacatatgtgcttgactccttttttttgcattctactttgtggagacagtgttgaagtggtcatttaagaatatgactgtgtttgcaaactatatactcaggagtatatagtctctctattcgcagtttcctttcctattaaactattatgatgtatggaatgcgcaagatttgggaagagcaaagcacagaatgtaggtaaactgttaagcagaatttctggcacacagaacttgctcaataacggcaggatgcctcctccttcctagtggaggaatttaaatgactgaatttaaattctgtgggttggggaaattgctgacaaactatatactcaggagtatatagtttactatataaacatgagtatattcatgtttatcagatttaaacaaatattttgaaattccgagtagttagaaaaatttatttttaattttttgggtacatagtagatgtatatatttatgaggtaaatgagatattttgatacagtcatacaatgcataataatcacaacagggtaaatgcaataaccatcacctcaagcatttatcatttctttctgttataaacattccaattatattattttagttatttttaaatgcacagtaaattattgttcactgtagtcaccctgttgttctatcagacactagatctttttcattctaactgtatttttgtatcccttaaccatacccacctcccttcccctgccccaatactcttcctagcctctggtaaccttccttctattctttatctccatgagttcaatcatttcaatttttagctcccacaaatgagtgagagcatgcagagtttgtttttctgtgcctggcttatttcatttaacgtaatgtcctccggttccatctatgttgtggtaaatgacaggatttcattcttttttatggctgagtagtactccattgtgtgtatgtaccacattttctttatctgttcatctgttgatggacacttgggttgcttccaaatcttggctattgtaaatagtgctgcaataaacattagagtacagatatcttttaaatatatgatttcctttctttttgttatatacctagcagtagcattgctggatcatatgatagttctatttttagttttgtgaggaccctccatactgttctccatagtagttgtactaatttatattcccaccgacagtgtacatgggttcccttttccccacaccctcaccagcatttattattgcctgtcttttggataaatccaagtagttttatgtgtcatgaacaaaacgtattatacacataatgaaaattaagttttctgatttttaagtttatatgcaaatacatcttaacatcttatctattttttaaaaagagacttcacaatggtttgcaataattacatttttatttcctgtcagtggatttatgtgtgtttgaaatggtttatattttatatgcatttagttttaattgaatggtatatattttatattcattcgtgatgaagtatttctaaggtagaaaagaccttaagttgaactctgaaatagcaaacacattgtggacatttgtgaatttatgttacttttatatgtttatttcttgacccttcctccagaaagccttcccctgatgtcccctgtctccaaccaggtggaaaagttgccccactttgggacacttatattaccctttcctgggcccatttatattacttccttccactttgctcttcttgagaacagagtttatataatatttatctttgatctccagtgcctaacatagtacttagtgagtgttgactacgacttcatgaaagcttaaaatgaaatagaagaagattatcttaatgtactgaaaatgtaaagcccatagtctgggctttacgtgagcaggctgaagagcaggagacctttgtagcacttctggagagggttttgaacaaagacatagaagctgagattagtgcttattctacacaaggcaccattgtggagagacaggcagttagaggggcacataagttagagttctctgtgcacagatatgcacagataacaacattagatagtattattaagtgccgtaagagtttaaaccatacatggggtgttttgggaattcagaaattacttctaatttggatgattggggagggctgtttgtttttgtttttcttttttgtcagaggtgtagtgagtagttttgaaagatggatgagatttcaagaaactgaatggagacaaactgatgacagctaaaggtctatgtagtgtgaagtggtacattagtttgggcagagagttaggggccagaattggggcctaattccttaggaatgttgatggaatttgcacacaattgtgttttgaccacactgagatttattcccctaggacatttatccagaataccagaggtcaactaagataactattttcaaaactacactgtatagtctgccccttacttaggagctaattatgcaggcttattatttttttttagcttttcatgctttttattctttctccttcctgttatctgcctataaataatttttattttgatcagcacctccatcagagtcaaaatcatgagtgtcttgcctacttttcatcagctctacagtatgaaattacagacttattatatgagaagaagatctcttccactgatagttaaattaattcatttaatttaatttggactgtaaagacatattcaaatctaccagaaaagtatggaatgagtacattggtaaagaaaatgcttatatttttaaaacacacttcaaatcacttctagtaatcccaggtacttgactatttattacgtttgtaagttctatgaagtcacgaatcatgtctgtctgcctcgctgatcgttgtatccctagtttacacttatcatggaaacatttaatgaatatttgataaatatattaagtatacttgataggctaattaaaacacatttttaaacatacatttctatatgtatgtaatatatgtgttacatataaaatcactttcaataaagtacagacattgtcaagaattgtgaaaagttagagtttgaccttatttgcaagtctcatggatagaaaacatgagaatgctggatcagagatgaaacatagttctttacctacaacagagtgtctgcagatatgctagttccaaaccctaagtctctgaggatgacatgaagaggaccagctgatgtctgcacacacagggagttgtattatagtagaggactctgatttggaggacctgaatcttttataatggacagtaagcctgcctgcccttttctttctagggagacaactatctgtcttcgttgactgtttatcatatatttatccttgaaaaaacagtctggactgggtttgtggcatgcgcctgtaatcccactcaggagactgagagaggaggatcgcttgagcctaggagttcaaggccagcctgggcaaacatagcaagactccatctctaaaaaaaaaaagtacattttaaattttaagaaaagaaaagatagtctggggaaaaggcaggcaatgcctttacctataagatatgtgaaaatgtgctagacccatggagaactattccctagtagacatataccctaaagggcctctgtaagggcattgcttttcatctaatcaagggatcagcagcaaactacagcctgtgggccaaatctagcccaccacctgtttttgtaaataaaattttattggaacatagacacatatgctcatttacatattgcttatatactacaatagtcagagtcaagtagttgtagagtcaagtagttgcaacagagaccacgtggcaaacaaagcctaaagcatttgttctatagccctttacaggcaaagtttactgaccctagatctagcctaaatatttgacatatgaggaagctttgtaaaatatgctaagttgacttttttctaaaatatttaaaaattttaagttattctctaatccttattgacttcttcacagttactgagagttgcctatctgtactatagttttcacattatcaagagttattaagaacctattatctacctctgaatgtaaaacttgaaaataaattttgaaagaaccaactatcaatgattacacctttttagctttaaaacaatcatgtaacaagttgtcacagtgtaagtgtttggtttatgagcattgcttatttgtcagtttatatttttgaaaaccatgaccgtcaagtaactgaaatacgggagtcagtatgacaaggtgaaaaagcttcctgggctctggaatctccaggagtcccggctttgcaactaattatcattgagatccttgacaggtttttttaactttctgaactttattttcttgatctgtaaaatggatatactcttactaacttacagaattaccattaaaattgaataatgtaaatcttcacatgtagtatgcattttaaaatattagttcttttcctaaaatataaacttaaaaaagtaaatcttatgtatttcttcagagttggaaagaactaaagtagttcttattctatcttcctaaatttttgtgggtaaggaaactaaggcttacgttggttaggtgactttaactcaagatgacaaaactagttagcaagtaaatgtagaattaagctctccctgattcccaagtattgttatttatagtaaatgatgtacatttgactgcatttgatacaaataagtaaaatatctgaacagttagaaatgagactaaaacataatatgagtttagagtttgtagtctcattaaaagacaccataaactagtaaagttgcccctgctctaagttttaactcagaagttctgagtatatttttattctttctctttaaggaaaaatattttcttgaaagatgtcatattacacacctgcatttgcttgaaacctggtagcttgataaatcgataagataactgggtcatatgttaagttttttgaaaaaccaacccaaacatagattctaataaaagaacgttacacatttccttttaaagtctaaaaagtatttctcagggctcttaaattaccatattctgataccaggggaaaataaaatctggacttagagtcttgtttgtacttagagggttttccggacaggaaggcagtcttgatgcaatgcagtaagccacaataccagtggggcattacaggtgaaaaatctgcagctgtaccccttcaccacagtgtattacaactgtatgctggaatatttcctgtacaaaaatagggtttggttaactttgtttcccaagagtagatcacattaaaatgttataaaatcatgatttcctgcatttgaatacttgtggtttctcaactggttccaatagtataagggtttttttttttttttttttggtatgacttctattagttgaagatgtatagaagcttttcttttccttcttcaaaatcaactaaaaagcagatacatataaaaagaaataatattataagctaaaacttttgagattgcaagcacattcatcttttatctcattggtagattttttaaatgatatagaaactcaaaatccaacttccattaccagaatacattttatttttatttagtaactattgaaaagtatctctactcaatttgcatttgttttgagtgatgaatatgtgtctcctactgtaaattataaataactgattgtaagaaatactctttatgtttaaaaggacagttaagccctaacacattcataaagagaaacctcccattattgtacaaagacaaagccggtttcttagcctattaaggttttgatgttcataatgctgtccatttatccctatctctagataaggactgtctctttcagtcactgaacatgtctatttcatgcccagacctcactttctattttttaactatctacttactctcctccagccatcagtttaaaactctttcacctatgtacttgtctactaattttctagtacttttctctttggggaatatatttggttttatcaccatcttaacattgtataagtgcagtatatacttttactttgttaatgacataaaatagcattctataattgaaataatagtttcacaacaattactctttcaaaagttactaattaggagctttcaggggcaaaaggcctcccccaacccccatgcccccactccctgccacaacacctagggttgtatgtcaaaaataattagaggcaattgattagttttaaagttgcttgaggcagtgggaaccagttggggtaaacaataggctaaccaaaatgtttgaaaggaaaaacgggaatgagatgtccatggggttttgaaaagctccaacatattcctgggaaactacaagtacatgctcatgaataagactatgcacacccccagggatgtgtgcctgctcagggaagacctgagaaggtcctgtactctcacctctgtctgtccttaaagctctgtgcaagcagtaagtgaaggctaaggaggagttgaaggtgtgcgccagagctcaaagagcccttcagccaagaattggaggcttattggttccagacctttagggaagtctgtttaatcattagctgactactacactaaccaagtggagacttcactaaccaactggagacttcactaatcaattggagacttcagtggccacacaatgaaaattacaaacttcacaaaattagctcataaatattactaaacaacaactacaatgtatagcaaggataataaaccctgaggaggctggaggcggtggctgatgcctataatcccagcactttgggaggccgaggtgggcagatcacctgaggtcaggagttcaacaccagcctggccaacatggtgaaaccccatctctactaaaaatacaaaaattagttgggtgtggtggtgcatgcctgtaatcccagctactcaggaggctgaggcaggagaattgcttgagccaggaggcagaggttgcagtgagccaagatcgtgccactgccctgcagcctgggcaacagagggagactccatctcaaaaataaataaataaataaataaacaaataagcaaaccctggggaagaggaaggatctgatttttaaagttccctttgtttatttacaataatatagttaataatgttatttattaatattataaaatcttatatcattaaaaatgccattttcaagaaagtagtatgagatgggcaaagaaataagaaagtacagcctgtatatgttaaaaaagcgatcaatagaaattgtccctgaggaagcccagatgttggacttattagacaaatacttgaaatcacctgttttaaatgtattcaaagaactaaaaaaggccatgtctaaaaagcttaagtataggaatcatgtctcaccaaatatagaatattaataatgagattgaaacaataatgtttaaaaacaagtacaaattccagaattgaaaagtgtaataactgaaatgaaaaattcactagaggggctaagcaacaaatttaagcaggaagaagaatgaatcagtgagcttgaagttaggttgttttgagattattgagtctgaagaacagaaaattttaaaaaatgaagaaaaatggacagagcttcagagatctgtgacacaccatcaagtgtaccaatatatgcataggggaagtcccaggagaggagagaaacgggaagaaagaatatttgaagaataatgggcaaacacttcccaaatttgatgacaaacatttatctacatctaagaagctcaatgaactctaccttaaataaactcaaagatatccacacttagacacaaactgtcaaaagacaaagaatattgaaagcaacaaaagagaagtaactcatcacatataagggatattctaagattaacagctgatttctcatcaaaagccatagagaccagaagacagtgagatgacatattcaaagtgctgaaataaaaagactactaatgagaaaaagcctgccaaatgaagtaactataaatgactgggataagtggcaaaaatgaaaatgtattctccgtttattgcttcctaagaacccactttaaagaaagtggaactggaaattgtaaatggcacattatggggtctatcttatttaatctaaaaattattaaagagcataggatttacaaccagaaagtttgccacttactaaatgtgtaatcttgagcaggttacttaacttcactgagccatatttcactcatttataacatgggaataatattttcctccctgaaataatgtgtaagaaaaatctgtaaatttgtatcttgtagagggctattcaaagggtagtttcttctaccacagctgccatcactacctgctactatcaaaacaccgatgatggtagatatatagctgttcttctgctataattacccaatttggcaccctgggaagtctagaaatatggcgggaaaagtgatgaagagagtatcctctgctgtaaccaaactctaataactaagtctagaatggaagctctggctttgtactcactaaccagacttacaccgtcagctaccctgttttgtcatagttgagcagacctgataggctacatcagttgctagatctcccctctctacctaccaactctttattaggctacatcagttgctagatctcccctctctacctaccaactctttattatgcacatatatacagcaaagacacttcctttgttgttttgcctaggttgcttagttggactgagtggagaaaggggtaatggcccagcttcagcagcccctgcgcaaagaaatccatgaggacagatgggcagtcataaccctgctaacagtcttggcagtactattaagtaataaaaacaaattaagtgccaaaatattctttgtaccaaaaatatttttaaatggccaacacacatgcaaatcttcccaaattagccatcaaatggaaacaaattgtggaataacattttaaatgcaaaaatacatgtgctcttaccaactggcagatatacaacctaagatattcatatgcaaagactacatatgcttagagtacagtttattatgtatggctggctaattttttaggtcctgtcaaataatggataggaaaacaaaatgtaataaaaaaatatataatcctgacagtcatttgaaatgtaccatgtgttacatgtggaatgttttccagtgaaaccaatttacttgttcccacttcccatgactcagtactagatattcgggctttctaaactatttttttggcaccaaactcttggaatagtcatctttccttcaagttattcagtacaggcattaataacaaatccttagttatagatattgtaactaaagatcattcacgtcatctctttcaaaactaaaagcacataataaagttattttaaatagatcacacaaaatagagcccagagttattccttgagaataattaattgctaccatatgaagttataagaacaataagaccacattaggtttttagcttaattatgtcaccaccaactagagattagttgggcaatgtcaacttctaactgaaagacaagagaggattagtgagttaagttaatgcaaagtttgttaaaaattggcatgaatgcaaaataatttgagtggaagtaccagtatattaaacaagatctttttagaataaaagactgctaaagaaggtagcatggttatttttaagaatactagtctgagaacgtagaataaaagactgttaaaggaggtagcattgttatctttaagaatactaatctgagaacacatggcatgcaagccaggcctcaagaagtagtagtaggttacctttagaaccacagccattgtctctactcctcctaaatcaggtgtcagttccaccacatgcttcacttccttgttttctagtcaccacccaaactataagatgcatttcttcctgtctagatactgtacctactcttaccaacctccctcttcctcagccttccatgcccttccactttgccctctggatcatcttctccttgattaatgaactctcccctaaacctccacctgttcttccagaagttcttctgtgccattactttgaataaaattttgctgtcccctgggacctagttcaccattgcgaccctctgatgtggaggctctcacgttctttttgtctcaaggccaggaggataagtgttctccttgctcaccagtgccactggcctttactcttcaaccctcttgtcaagtccccttgcttctcattttctctaattatattctcctcatccctctttgttgttgccatctactaactttttggtcattctctcccattctcacaagtccttaccccatggctgccaacctttttcttcactgccataaattacccagccaaaaccctacgttgatctcatatctctaggaatcttttccactccatttaactactcactcccatgcacaagccctggatcttgtcatcatccacaactgctgtgactcctaaatcattattccagcatcttaagctccctcacagtctttcatagctctctgtcctgcttattcaaaaacccccactacagttattcattaaactattcattaaactgtagttctctgatgtcctcttttcatcagctcaccattttcatatcctcttttaaccagtttgcattcttagttcatcatttaaaataccttcttacaaataagtaacctaaacttcattgccctctgtttttccactatacactcctgacaaaaggctagtgctgaatgaactgtagctgtgtatcagcacagttaactccctcttccagtctccagaattgccaaccccttattcagtatttttgctgggatggctcattggtacctgcagctcagaatggccaaaaatgaacttctgatctctcctcctctacccacatatactacgtatcagtcttacccatcccagtaaatgacatcagcatccatatggctgctcaggctaggaaactgggagttattcttggcacttccctctcacttctcagccaatcaatcaataagacttattaattagtatgtcccaagaatctcttacatactactctgttgccaccaaccatactctcagctatcaacatttctagcttagacctcctaattggtcttattgcatccacgcttgtctctttttttctttttcttttcttttctttttttgtattattgttattatttttgagacagagtctcactctgtcacccaggctggagtgcagtggcatgatctcggctcacttcaacctccgcctcccaggttcaagtgattctcctgcctcagcctcccaagtaggtgggattataggcgcccaccaccacacctggctatttttttattattattatttttagtagagacggggtttcatcatcttggtgaggctggtctcgaacttgtgaccctgtgatccacttgcctcagcctcccaaagtgctgggattacaggcatgagccactatgcccggccacttgcctctttttattccgttgtctatagtatccaaaatctttgaaaaatacaaatttgacatcacttctttgctttcagcccttcaaagaaaataaagtcaaaaatccttaatttggcctaaaaacaatacaggttttattatccttgtttacaagtgagggaactgaggctcagaatcattaaataggttgcccaaggtcatagagcagtgatttaagtggtagggccaggattttatccgaagtgtgacaccaatgacttttttttttgtaggatggagaaataagataatgtaaagatgatgtctacatgcttttaaaagtaaatttatggttcaatatgtatttgaataaaatctttaaaatattgtactcagtgttgtttttaggttttatttcgatgtgttaaggacaaatagagttagccttttgtatccatcagttctacctccatggattcagccaaccaccaatcaaaaatattcaagaaaagaaaattgtgcttctactgcacatttacagacttttcttgtcattatttcctaaacaatacagtgtaacaactatttacatagtatttacattgtattaggtatcatgaggaatctggagatgatttaaagtatatgggaggatgtgcataggttatatgcaaatactgcagcattttatatcagggacttgagcatccatagattttggtatctgtaggtagtcccagaaccaacccctcatggatactgaaggatgattatatattcttataatgggaaaaaagaataagtacgtgacttttatacatgtatttaaaggcatacaacttaaatttttaataggggtttcatttggtgtgaatttattaatatgcctttgttaacagagtaaaatagggcacataaaggaaaattctgacgcataactgacatactttggtatgtatctccatagtaatctattgttttctgaattttcagagtagctgagaatattccagctgaagtatgtaactacagagccagcctcacacaagttgtgaactaaataaagtttttctttggcattcttccacatctcttactttaggctcccagaattcctccttccctaaaccccactgttggtgcagtccacattcattgcccctaggctacctaatggcttcccacagcagttcccatcttggactgccttatattatgtacctactccaaccctcgccttgtacttaaaaacttagtggtgctttttccttaaggtcctactctgccttccaatgtgccagctaatttttataagctattatatattaattttaatgcagaatttcaggagatgatgctggaaacaagtattttttgcatattttctgtataccctctccaccaaaaagattacattgaactttatattccgttatttgtattaccaaaaacaataggtatattaatatgctttttcttttgggtggatgataggcaattttatattctttgttgtacttgtgtttatgcaacattttataataaacacattctttaattttttatttttagttagtatgggtacataatcatatatatttatggtatgggacacgtaatgttttgatacagacataggataaataagatctgatatttgatagcacagcaaggtgactatatcattaaattattaatatgctttttctcaactcatttgcccttcccttgtccactgagtttttgtttgtttgcttgtggttttttttttatttttttgaaacagggtctccatctgttgtccgggctgggtgcagtggcacaatcatggctcactgcggcctcaacctcctgggttcaggcgatcctccgacttcagcctcctaagtaactgggaccacaagaacatgccatcatgcccagctaattttttttcctcctgtagagacagggtcttaccgagttgcccaggctgatttcaaactcctgggctccagcaatcctcctgtctccacttcccaaagtgctgggattataggaattaaccactgtgactggcctccactgagatttttatatgtctctctagggatttatactccagttaccatatctcttccaccgctggttgttatgagtgtcttaaaccacagggctgacccactggcagtccagagagtagttaagcaatgatatattcctttatctctgaagtcatagcatatatggagggccacacttttaacaggtatgtagcagaaaataatattgaactgtgggtacagtgttcctgaacatccagattcatagtttattattttcttccaagaagtccaacccattattaagaaatctaataatcagaactcttacaacttacctgattctggcaacaacatataagcttccaaagtgttctttgagcatgagaggggtaaataatggctaacatttcttaagctcttactatgtgatattaaataaaatgctttgtctcatttaatatttatgaaaattcatgagggtagctatattcttatcccccttttacacatatgggaacttgtgttagaaaaattaatttaatttaggcctggcacagtgggtcacacctacaatcccagcactttgagaggccaaggtaggaggattgcttgagcccaggagttcgaaactagcctgggcaacagagggagaccgtgtctctataaaaaatacaaaaattagtcaggcatggtggcacgtgcctgtggtcccagctacttggggctgaagtgggaggatcgcttgagccagggatatcaaggcttcagtgagctgtgatcacaccacttcaccctagcttgggcaacagagtgagaccttgtctcaaaaaaaaaaaaaaaaaaaaaaaaaaaaaagaagagaaaaattaatttgcccaagaaaaagttaatggagctaggatttgaatcccgatagatctgatccaaagttcatactttcaacttctatacttctttgtggagaatctttaatgtgccagagatgggttgaaccacccagaatgtgtatattcattcattgattcatgaattattcattcatttattcagcaactctttttgaacatttgctgtattcactatcccaggtgctgtgaaaattcaaagcttagccaaatagaaatcattccctcaaggaatgtgtccaccagagaagatgtcacatacagaaataactataacatgaagtatatagtgataagagctgtaaaagacattcccattttaaaaaaattatttgtgttcagaaaagagaaaggatttttccatctggggaggtgaaaaggctgagataggtggtattctatttggttatggattgatgtgaaggatttagacctgagacagtgagaaagtagggggtatagaggtatttcaggctgagagagaatataggagcaataacccagagaaaagaagttagagaaaattatgtcatggaaagcaagaaaagagagaatttcaagaaatggtggctaaaagtttaatgccatggatatgtcacttatcactaaccagaatatgtgctactatttcatcacatttaccctcttccgcatatccattctcccctcgtccttacagcatctcatcatatatggatgctcaagtcactgtttaaagaaaagaaacttaattataggtggaggtaacgtttatttcaacatttagtcctgttgaaagattgagaattacttatttaggaaagaaaggttagggagcaatctgttcattaaagaagcttttttgagatcccattttgtcctcaaaactgtgttaggtgctagtaatatttttttaaataatgtgccatttctgccctcaaggatcttagagtcaactaaaggagacaaacatataaataagtaattacaaaatatagtgagtcctgtgttagagtagtgtactaggtatagacatgacacaagagaggcagtgatcagttctgaggatggtaattagggaatgcttccaaaaagggaaacacatctgagccactcttttattttttaagacacataggattaacccacatgttctcatcctaaacaaaataatatttcctagatgtctttttgtgttaatatagagagagattcttttttttttttttttttttttgagatggagtctccctctgttgcccaggctggagtgcagtggcgcgatcttggctcatggcaacctccacctcctgggtttaagcaattctcctgtctcagcctcctgaatagctgggactacaggcacctgccaccacgcttggctaatttttgtgtttttagtagatacggggtttctcaccttgttgatcaggctggtcttgaactcctgacctcaggtgatccacccccttggcctcccaaagtgctgggatttcagacgtgagccaccacacctggcatagagatatactttattcattttaacagttgtgtagaaatacatcctatagatctgcatgttacatgtaaccaatcctctattgatgatattcgacttgtttcaacttttcttattaataaacacagtactgaagtacatacacacacatatgtatatacatatatatgtgtgcacacacacttgtgctttggaatctctgtaaaacaaattcttagaagcatacttcctaggggaaaaaaaaagttttggctaggcgcggtggctcatgcttgtaatcccagcagtttgggaggctgaagcaggtggatcacctgaggtcaggagttcgagaccagcctggccaacatggcgaaaccccttctctactaaaaatacaaaaattagctgggcgtgatggtgcatgcctgtaatcccagctactcgggaagctgaggtgggagaattgcttgaacccaggggccaaggttgcagtgagctgagatcgtaccacttcactccagcctgggtgaaaaagcaaaactctgtctataaaagaaaagttgtttttttctcatgcttgtacagtactcagaccgatcagtcttcttaaactgaaaggttagtaaataaaatattacattattgctttaatttgaatctctttgagtattggtgaagttgagtatctttttatctttttgtgtttactggctggttatattttttcttctgtgatctaactgctgtcaggatctgggattttacccagtgcaagctagtaagttatcttgttagtgtttcatgggtgctggcagaaggaataagactcctggtcagaagcaaagaagtctattgcttgtggcatggcaagcagcatgagcatcatgttttcattggttccccttgttcccaagtcccacaagcgtgatgcagaagtgcccccagggggatgctctgcttgcagtagacatttggcacagttgaggaacttgtaaaatctaccttttctctgtgattatgtatcattttctcattgatttgtaagagctctctcctatcagaatgaatattccttcacctgtcatcaaatgttacctgtcttattccagtttactttttaaaatttgattttatcatgggtttcatgccatacatacaaaagtctaccctattataacattttaaaaatattaacatgtttcttctcttacactttcacttcttagccttcagcagttttatccttttggagtttacttttgtgtaaagaatgatgtagggacccactttggttttaccaagtgactagttagttcttgcagcttcattttccgtctttctcctacttatttggtgtggcaccttcattactttttttttttttttttttttttttttgaggcagattcttgctctgtcgcccaggctggagtgcagtcactggtgtgaccgctgctcactgcaatctctgcctcctgggttcaagtagttcccctgcctcagcctcccgagtagctgggattacaggtgcacgccaccacacctggctaactaatttttgtatttttagtggagatggggtttcaccacgttggccaggctggtctcaaactcctgacctcaggtgatctgcccgcctcggcctcccaaagtgccgggattacaggcacaagccaccatgcctggctggcaccttcattgcatagtaagattttgtctgtacttagccctttctctgctattttattcttttaatctatttgtatgttactacactagccttatcttttacttactatgggtttataatacatttaacaccttgtagaatttgttctccattattacttttaaaattttggctgtttttatatattattcttgaattggtctttaaaaataaacaggatgaatatacaataatatgaaaagaaatcctaaactactgtcttttataaccttattctcctctaaaggtcttaatgttataatttttataaaggtttaatttgaatttcaacaaatataaaagcatagtttctatttgcaacttctaaattttttttattttaacataggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaaggtaattcattgaaagatgatatggtagcattacactgggaaacaatgataagtcatcttttcctatctagtgacccctcacttaactgtatctcagctgtctagcagctgcatctctctgaacaacagatgagaaccacaaagaaagacaaaatctgatgtttcaaagtctgcatactcaaaatcctgtgtttttactcataatacagctctgtgagccctcactaagaacctgttccttaaatataaaaagaaaaaaatggaaaaaagcaagttaaacaaaaagtctagtcatcttcaacctcaaaatacagaggcatacagtcatacacacacctcaatagaagcttaatgacatcataatcaatatgtgtaatgattatcctggggcattaaaagaaatgttaaaaaaaaattgaattgtctccttctaaaaggtaaattttaggaatattttcatcttaattgtttttttaaaactttaaaagacaagcctcccctaggtgacaaagtgcaactctctcaaaaaaaaaaaaaaaaaaaaaaaaaggcgacagtcctccagacactaagaaacttgtgtagctaaccaaaataactcatacccaatggattttatacagataaagttttatccacctataaagcctcactggccataaagaatccctagagctggccgggcacagtggctcgcagttgtaatcccagcactttggaaggctaaggcgggtagactgcttgagcccatgagtttgagatcagcctgggcaatgtggtgaaaccccatctctataaaaaatacaaaactagctgagcatggtggcacacacctgtagttccagctacttgggaagctgttggggagaggatcccttgagccccggagggtgaggttgcagtgagccgtgatctcaccactgcactccagcctgggtgacaaagcaagaccctgtcacacacaccaaaaaaaatctctagaccagattatcctcatttcagtttttgcctacttaacacatccactaatttacagtagagaaaaatagcttcagcaatctattcttcagcacttctagcttacacacatttgctaagtccctttgctcatgcccccataaaagacgataaacaaagtaaaccacaaccagtggaacagctttcttgggtcatatactatcatgtgtactgtgaggctatgctgttcattgctgtggatgccctacgtgccacttctcctgatgggctggcttagtgttgttatcttattccttttatgtaataccttcttctttccctggaaacaacattctgacagtaacagaaaaaaaaccatccaccattccaataccttgcaaatcaaatgttttttcttttctctgttaccgttctttttgcccatatgtgtacacgcttttacaaggttataatcatagcacaccactttgtattccagttcctactttttattataaattattgtgaatactttttctttggaaatatttatttttattaacatatgttcattgaagaacatttggaaaataaaacaatactgcccataattacaaggagataacttctgttaacattttggtttgtagcctcatagtctttttcattgattattttgtatgcttgataataatgtgttttgtgttttatatttcatatattctatttctaggtcatttgggctctttaaaaatatttactttcctaacagtttagctagtattgtagaattagtgaaaatatattagagaagtagtgttttaattttacctgcatatagttcagcaataaaaagaacacccatcctgtgatgaattatttcatggatggaaagattgctttttctaagttcaggttatctcatcagaaaccaggaaatctcagaaaatagagctatggataactaaattgatttttttaaatctgagtttcattaatagtatcaagttagaaatgacttcttgattctaattatgaagtaatacattttcaccatcgaaagaagcattgtagagaaagctaatgcctctgaatctgaaacatttataaaaattacttttgtggtaagcttagcagtatagaaatgtggagcctttaggaaacagaaatttaagcagataatcaaattcaggcagtttttcaccaagcatctgacattgtagtcacagatctttgtcctcaccagggatttttcaccttacctaatatttcacaatttatctcactttaaattgtttgagactaatcatttttcagatagaagttgatattaatgaaattaaattagaagagctggtttaaaagtcaacaaaataaaacactattaaggattatatttgtttcatccaatttctagaaagaaaacagtaatgatttgataatatgtcaatatttcatgcagacagaaagcttttacagttagcctcagtatattctgtcacaagagaaatctaaatctggacaaaaacctggtacttttatgattagagattgtcttataaaggatagtctcagtggtttgagaaggatttacatcagactattggacattactggaagaaaggtcacaaaaatatatcccatgaagcctaatttaaaaagaagagcctcttgcctataattgagatgaagttttaatgttcctgtggtaatggcatcaccgtaaatatgtaaatagagatagcatttaatagatgtagaagacctctattccacctttcaaggtgaagacctaggtttaaggcctggctccatcaacaatatgctatttggtgttgtgagattgatttctaaactgagactttaaggaatgaataggcactaaccagttcaatggatgacagggagcccccagtgcaaatgaccaaagacaaaatagagtcaataattgggtgggttcagtggctaacatctataatccctgcactttgggaggctgaggtgggaagatggcttgagctcaggagttcaagaccagactgggcaatagtgagacttttgtctccacacaaaaatttaaaaattagccaagcaaaacggtgcatgcctgtagtcccagctgatcaggaggctaaggtgggaggactgcttgagcccaggaggcagaggctgcagtgagccaagatcacaccactgcactccagcctgggtgacagagcgagaccctgtctcaaaaaataaaaaatgagtcattagttaggttcctatatctttaactaatggtttgcttgatcatattatggtttttgggagggagcatttgaagtaaatgttgacctttatagtactgacctttgaaagccttccccttctatttgctgtgcactggactagaggcaagggatgcaccctctggagccctggtcatgctatccatttcagctgtttatcttactcccatcgtgtatgtatttgtccacacccattgcctgtttccaaagcctaagtaaacctcttatcagtcaggttctgacaggaaacagatggcaactcagactgggtgactggggaaagtttaatgaactgcaaaagtatgggctaggaaccctgggaaactgtcccaatcttaggccaaaagaagccaggtgatagagccattatcaaaactctaactcagcgaggatgtttgtagctacgtttggtagaggaacacagctaatgtacagagatctggctgcaaaggaaccgggaaaatacatacccttacctcattcctcttctgccttctaagtcaccttgtgggtacctcccactgactgaatccgaggacaagccagaggacaaagtagcttgttggtgcagtccagaaagctcccttccggaggcaaagaagaaggtggggaatggtagaaggtgggtcaagagagcaaacagaagacatccagcaagtgcacactcttatttgcaattggcagcttcttaccaggtgactaaccctgcgaggaacaaaagggaaaaggaatcatgagccctactctcttgggccagcctggcaggttccctgggtttgaaatcaatcaggtgtcttctgatggatcagaacaatttttactttatttattccctcttaccttcacccctagagagctaattccagaaatacttattttggctgtggaaagtcacacaaattacagacatttattatataacacaatagtaactgtgcagatctcaatatgtatgtctggttaattctgtataagttgtttgatgataatgttaaactcttgatctgtgccaagactttggtactttcctgtccatatttcatggtcatcttctcacaatattaaagcatgtgagagcagattgcttgtaaggactttttatctctacccacaaaatgctgactcatgacagaaggcatcttggaaagagaaatggcttaagggtgtatggctctttcttcatgtgataaaaattaaacctctggcgagttgtataaagtgctttttaatatatctatatattttttcttcctactcccttaaggtctcataaaagaaatcactgtccactcatatttgggaatctttgagacagtgatccacagcctgtgtatatatgagtgtgtgaatgtgaagaagaactccttttcatttcccaaaacctttattcttgtgtatatagacagtggaggaatcagagaaagcgtgatgatgaataagtccctgaatcatttcttttctctctgctggttgaactctctcctcccaaaaagtgactgtggccttccagatattgtttctctccatttggctacttgggtctgcccttttagatgtatctagatttttgggtaattcatttagtgttataagccatttatacataaatcttgacatttggaactgctttgtcacctgtgtttctagttacacactggtataatccaggatttatccagaaaattctttcctttacccttccctaaggctaaagctgagtttttgtcttctcttccttgaatggaaggaatacttacattttttccccaggtttgcttttgaggccctttgctattttcttttaggtggtgattgaactctgtatacgaagtcctccagggagttggcctttgccatgcagtccttcttgcatacacagtccctgaagtactcaggtgctgctcaggtctcagagttcttggatgatggtacttatgagctctctatgtcgtattgcctactctatgaaccttgggagattactcttcctttttttttttttttaagttagatttaaaggagtgttttacctgaaggctcatttaaggttatttttcaaactacaaactggagcacattcatgggttatgaaatagctggttacaactggaatttttttaataacataaaataaaatagaaaatagtttgaaaaagacaaatattatatgattctacttacatgagatcccaagagtagtcaaattcataaagagcatagtggtggctgtcaggggctgtggggaggggagagtagggagtgagggtttaatggacatggagtttcagcttgggaaaatcaaaaagttctagagatggatggtggtgatggttgcacaacaatgtgaatgtacttaatgtcactgaactgtacactttaaaatggttaaaatgataaattttatgctatataagttaatatattatcacaatagaaaatagtatgcatcatattttcagaaaaccttttcccctgttttatatgtgtatactggattacaataaaagtgtgcttgttatttggagttagggttaagacatttggaaaacaaccattgtaaggagtggaagaaatgcagtgcaacaggcacacactcctgcatcctctctcacctctctcctgcgtcctctctcagccattcagcactctcacgggatggacagagcagtgttcatgcagtgggtaggggagaatttatgtgaaccaacgttgagagacagtgccccattgagatgaatgccagtatgctgttgtgagatccctcttaggaagctaaagataatcaattaacattaacctatgtagccagtatggtaccttgtcttgcccgcaagaaaaagaggaatggatttttttcatcatttgtttttaatcaagtggtggacatcatgctaagtagtttatatgcagtagctcatgtaatacttgaaaaaggtaggtctaattactgtactcattttataaatgaaaaatacagagacttagccaggtgaaataacttgcataatactatagtataaatgatagcagcgcatacattattctaggttctcctaccttggtcattctctgcttaatctcacaatcatggcggaaggcaaggaggagcaagtcatgtcttaatctctatgctatattatcctatattataaaatctttattaccataaagggatccatagagaagtgacattcagagctggatctttagggattgtgcctaggtccccacagtgccattaagataggatcagtctacatctagatgtactgaacactccttgtttaaagaattgatcccctctgtaggtcactcaggacagttggtaagtaactctttggctaaaatgaaggtataaataaaacacctgccatccttctcactgtctaggatatttccactatcctaaaaacaacacttaaataaccctctgaacttaaagctacttgaataaattactgaatcgtgaattgtgtttattactatttgagaggtcttgcttccaggaactattttccagttaaaagtgaagagcaccagataattctgtgaacactgtcattggccatgaatttgacctgttttgaaagtcttctgggaaaaggggaaatattgaaatataaatattataagttgtgatattttttacttttctttttctgcttattatacatctgatgtttgaccttttaagatgtgaatcagattaaaatccactgttgtacttaattagggaaattatacaaatgtagctactgcaagtctctagcagggtcatcactcatatttatgactatttagtcctattgtacttagatcattttaatccttaggtaaaaggtaaacacatacatgctacttttatagtatataatggtgatttaagttaagaatatcaaaaactataaatgtgctaatgtaaaataaagttgtattcaaattacatatactatattttgtgtttaagaagtgtgtgattttgttgactccgatttttaaataaaagttttaatttttgcatataaattaacctagtaaccattttagtcgggatttcaagattgaaggagtattgctgactagagtagtgctactagcactaatgcttactggagtatgattttatgattcaggagctactgtatatacctaaaaatatgtctaaccattgctttgtgcattcaatttaggaaaagtgaagaatcaatcaatttgttataagtaaagattgtattagatactcatgatgttttagcaaccttttgtaatatgttataatatttgccactctcaggagatagaaaaataaatcttggaaaatatcagagtgtcaaaaactataattggtcagaaaaatgctcaaactgtgtacccattttaaaaaactggtcccatagaactcttgcctggatttttaataatattttgactaacattgtgccctatttctaaaaacttacatgagtagtataagggaaagagttcaaatgtgtaaaacacatgtacaactaatatattttcctctttctgaataaatacaagttttaattttatcttgccaatgaaatcttttgttaactctacaaattcctagaaagttacttggattactgtgcccattatagatgttttaagaatatacttagctgcatttttgtgcatagtcaataacctagtgctccagagtctgttttctttgtctgcaatggagatttactagcattgcagtaaatgcttacaccacataactgaaaaccctttgaggttaaacaactcagtaaacatgctggaatgctcctagctttcattttcaccagcctgtttcacaacctctttcaaaacccaatggaagattcacacctctgaaaatcccacatgattcacccatgccattaagttcctcttgtgtttccaccctggcagcacttcccactttcctattcctggggggtcgttctgtttggtaatttttgtaaatgtctacgtattgagtatcaccagttagactgtgagttctttgaaaatcaaggatttgtttctttagtgcttcctgtcatagttctccctaggatactgtaaatgacattgcttgtccttaggctcctcatggatttgggagccaggctgtgatagctacagagcatatttcaggatgaaaagaagagagtggaagacagtgagctgtggggaaagggcaacattgattcggtgatccacaattaacaggacacaccttgttctcctccaacaatcccaaattcccaggtctcgtgctcctgttagcattaatgcaatctaggcagcatgcttcccgtgcacagcagcagccaccatgtgcagacatcttcccttctatggatgccatcactattcactttaatcagatttaactcatacaggctgggattggtggctcatgcctgtaaccccagcactttgggaggccaaggcgggtggatcacttggggtcaggagttcaagaccagcctgatcaacatgttgaaaccccatctctactaaaaatacaaaaattagctgggcatggtggctggcgcctgtaatcccagctacttgggaggctgaggcaggagaatcacttgaacctgggaggcagagattgcattgagccaaggttgtgccacgctgctccagcctggcctggacaacaaaagtagactccatctcaaaaaaaaaagaaaagatttaacttgtataaaatagtgttaagaggatgggcaagtgaagagaggacccatgcattgtaattgtccatgggaccctcattcttctggatatggtcataacttttatggcacccgttacagtagtgagtgagtgcttaataaagaatattgactgactcctatggaaatatgggtatggacaatctggagaagtaaaacaagggtgaaatatttatggtgacactgaagtattgggtttttgagtggcagagtcatactctgaactgcattgatcttaaactaataacagaacaaatggcccgtaagttttgtgagatgtggatggaagcacattgatttggagatcagtatgatcatagatcagtatgagttggcatttgaggaatcctttaaaagttttctgtgaacaattcatagagaataatcaacatgattccaggctggaatgcagtgcacgacagccttgacctgctgtgcttaagcaattctcccacctcaaccaccaagtagctgagactgcaggtgcatgccaccacatccagctaattttctggatgaggtgaggtctcactatgttacccaggctggtctcgaactcctgagctgaagtgatcctgctgcctcagcctcccaaagtactaggataacaagcatgagccactgcacctggccaaacacgagcttaattttaaaaaatagctaatttacataggaaaatacagaagatttgataaaatattgactataggattttcagtactagttttagaaacccttataaaaagacgtttcactcatataatattgggaaattttggttattgaacttcttttatcacttctttcccatagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacaggtactcttttttttagcatcagaataacatccatttaatacttaccattttctcttgagtgttttcaaaagagaagtcaacaatcttagataatgtattttcaggaagtataaagcgagcagtggcaaagttatcctggggttgacttggcaaaacaggcataacctttacttctgaaccagcttatgaacccattatataagttgtcaatggtattgagctgacatgtttttgaatgctacctaatgagaatttttcaaggaagttagttttactgtaattctaattatgatcttgtattagttcatttttcacgctgctgataaagacatacccaagactgggaagaaaaagagatttaatggacttacagttccacatggctggggagacctcacaatcatggtggaaggcaaggaggagcaggtcacgtcttacatggaaggcaacaggctaagagagcttgtgcagggaaactcgtttttttataaccatcagatctcgtgagacttattcactatcacgagaacagtacaggaaagacctgccccactgattcgattatctcccacaacacgtgggaattcaagatgagatttgggtggggacacaaccaaaccatatcagatccctttgaaagaaatatgtctgttcttgttcagtatcctgagtcattacattagtagcaaatagattccaaaaatacttggtattgcctgatttcaaaatcatgaatactttccacaaaagataggcacagtctcaaattaatttaaaggggtatcatttttacaagtttggaaggaagtttaaattttcccacacaccaaaagtggccttttataagcttactaatgttatttgaacaattatttctcaatatgctctgtaccaaaccttttctaggtgatacattttgactcatatattaggtttttgacctacatgtaatgaagggaagaggagaaaatcagattaaaaccaaacacagctggctgggcacagtgactcacacctgtaatcccaacactttgggaggccgaggcgggtggatcaccatgtcaggagattgagaccatcctggctaacacggtgaaaccccatctctactaaaaatacaaaaaaattagctgggcgtggtggcaggtgcctgtaatcccagctactcagaaggctaaagcaggagaatcgcttgaacccaggaggcagaggttgcagtgagccaagatcacaccactgcactccagcctgggtgacagaacaagactccatctcaaaaaaaaaaaaaaaaaatagctgttgttaagcatcttgccttttcagcaaaaatggagtttaacctgctttctctaactctctttgagtcatgtttttgttttggttttgagatttgattggtagctacagagcagttctataaaattctctttagatagatacctgcttttcagtttatttattggcttctgtgatcaattttttgtgaaagttacttttggacaatatatatttaagaggcctaattgaacaaaacagttttgttttcaaatatcaaatgggaatccaaagattataatatcttcaataaataatttgaatttattaaacaccaaaaactaatttcaataatcaaaaagtgaatagtttgaatgtcatttcactctttattttcacaaaatattggctcatcttaattgctgttttccttgtttgttttctcaacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacaggtatgcacattccataacagtttacagtttggccacatatgatcttttattaggttctgtatgctatcacttctgataataagttcaacacaaacaaaaatgttagagaatgaagaatttgatgggcaccattatacttgaggccttctctgttttggcaaagtgatgcatgttatttttgaaaaactggagaatataggttctctacacatgcattggagatcatgcccacatttttgtgactaatgcaccacatctgtgtggaaagtaacatattcccagaaattttttccaagtattgtggctttagtttgccaaagcttcaacttagctatgtatcaaattgtctaacggtccattgcagaaataaagaacctgtgtgaccctttctaatgataagcattcgatcttttcaaacaaacaaacaaaaaaagcagcgagatgaaatatgtgagtacaatacagtcttagttttttcctctactctttctgactttttgattcactaaaaagtactagataatggatttttaaatcaattagagagccttgattattttaataattttttaacttttatttcttatcagaaataaaccaaaccaaaaaaagggatgaagcgtaagtctatgataagtggcatatttaaaatgggaaacctgtccatgtctgctagcacaaaagtaacttcacagaatatttggatgataatatgttcaatgatttaagaacaaatcacttctgcttcccttactgattttagtgttatattgtatttccatcaagtttgtgttgctatttaagctgaaacatttccccacattttgtatatattacatttgtgtgaggctggctacccgagagaaacggtgcttcatcccccactgacctccttttgggatggagcagttaaggggaagaggagcttttgttctctaacttaagaatttgtatgagaataaatatttttctttatatgcatgaagacctatacaagaccaaggaattaattacctaacatggcactataatagcaaagggaaagaagataacacatctgttttatgttttaaaaatattttttaagggcattccatggttttcttgttgcaaaggacatgcgtaaaataagagctagtgtgatctaaatctttgcagctggttcaaatagccatgtgaaaaaaaagacctctatggctccaatttctgttttttggttgtattttgaacaatacatttaataaaaaacaaacctagaaaatataaaagaatcattgatagaacatttaaacccaggatatttttgtcttggtatcagaaccattataaggggactcatgtgtagcaactactgcaaaatggccttcagaaataccagtttcctcccagggtaaaaatactctcttagacacagctatacatataaataaaatatggtgcataaatatttaaatgttttaaaccacatcagagtgtgaatgactgactggctaacatagtgccttgaaggaatattctgagtttttttaatggaattgtatatttgattaagtagagccatatgtcacgtagcatattgctgacaggtacattctatgaatagttggttctgatttatacagggatttggcaacgttaacatgagccacaagaggatatacttctgtaattgttgctgtaattttcttgtttcctctcatgtcaagggtacttgccaccaagttttaatgtggtaggcacctaaccctgtgtattctaaagtaaatatgaaagtgcactactttgaaattataggacatttgacattgaaatgggcttacaaagggttattgagttcattgtttctaagatgttctgaatgtggtttatcccctttagaagcggaagtttagtttcccaaacttggattttattgtgtgtatactgctcacatatagtgtaattgctgccagtgaaaaatatgaatttaataagcaagcaaagtgattttagttctccacataccttttatcggattcatattggagacaagtcatttttccccagtgtggatggaccagacagttgaagcatgaaacaatttggccttccacctttaggtcataagttcaagattaacagaagccttcatcagtgtctgatttctctggctatagattttcttttcccttttataaatgatgactgttttgtgaaaacagattaaggatccaaaatgccatttgcaatttgttttatatttctatgtcactttcccagatttggacaaaaagtattaaaagggtttttttcttaaattaaggttacacttatgtgtcttctcttacaccaaaatggtgtatctgtttaactgcaaatgcttgtatgacactccatgaaacttaaatgtggataagccatcttttaattatgattccaagtgagcattctgaggctcaacatctatgatgtgacgtcaaatacatgtgaactttttaatattacaacagaatttaaaacattccaagaaatgcttaaacttattacagttataatgaactccacagatgaagcagcagtagagaaatagttccctgaggactttgaatattctttagaaaaatgtaaacaacccccttgtgttctttaatttacattttttcctaaaaccctcatcatttattaaaggtcagtttttagagatgaagaaagtaatatgatgttttttttctgctcaagccccatctggtaacttaacctctgtgttaccagcagattgatcccaattcattatgaaaactgaattttaatctcaggatgtgtaactaagtgggagattggaatcatatccctttcttcatgtctgtactcgcactgaaaggaaagaaaaatgtttacaagtagagcagttcatgttgattatataatgctcaatggaaaaatctcatcaaaactaattacatactatgattccagtttgattgaaggtttgtagataaatatataaaaaaggattggataggacagactagaatagtaacaggcaggacattcagaagggaaaaactatttgaagaaaattcaccaaaatgttaatagtagttattgctgagtttaaaattaaagatttttaaaaatccatacttcctgtatttcctaatttttccctccccttcttctcccctgtattttctaactttgtacagtgaatatataattataattttacaaattaaatctaccaaagttttcgtttgtttatttcctaagtatttatcggctaggcattatgctggatactgaagataaaactgtaaagaataaaaactgtaaagacgtggttgctgcccttctgcagcatacagtctaattatggagacaatattgaacccataatggtacaaattaacaagtgctctgaaggtgaaatatagaatcttatgtaagcgtaaaataggagaacctaccttgaccttgggaggatctcagaaggctgctcttaaaaccaaccttaaaacaggaatctggaagttgagtagaaacaagttggtcaagcaagaaatggagaaaaagatgtccaagcagagggaaggctctgaggcaggaagtagtttgatgtgttggatgagttggaaggaggtcagcgtagtgctggaggagctggaaaaggctagtggagctggagtgtcctgagcaaatgccctcagcaaatggagagtagctcaagatgcagttggaggcatgggcaggggctgggtaagatgattcatctaaaactcaacagcagtcaagttttgaaatcattgctaccaattaaaatccatagtagagagtattatggtagatgacagatgcttgttgttatgagtactttggtctcacttagccagaaactcttttggcgattagtgtgactatgaagcaaggttcggttcaatgggaatagatggatgatgtgagagggcttagaagtcctcaagggcctctggaagaataaggtatgtcagggccacttcaccacctgcagcatagagcctgcccacctacttcaagggcattctggatgattaggagtagattctgtttcccaagatgagtctgtaccctaatgggtacaagtctggtcatggcccaggctggattccaagtacattcatctgtagtctccttggcttcatgcctcctccgtacttgaatcacaatgcttctgagttgtatctctgtttactcccccacttctcagtaaagtggcaaatgatggagtgtgacattttgacattatttagatccatagccaggaaatagaggccaactggagaagcatcagttacatgttatctcccattatctgcaaattaattagctacttatgatgtttttcttatattctcaagttaatcatttatttagcattcttttagtttaccaaaagtatgtttattctttttaagccatagcctaaccagagtgataaaagagtaagcaaggaaatactttattactttgccagtgttttaatgtaacagcaaccaatggaggcaccattaaatgagaaaggagttatcaacaaaggaacgtattattaatttgctgcgctttagctgactaatgaaggattttagctgactgatgacttagctgaaacaaatactgaaaactgtttcaactaacattatttctcaagaaaactgcaacttggcttacactgactctggagttgatctgttttgtatgttcagcctcttaacaatagagggaaagttatggttttatttacatctctcactgagcagatttacacacacacacacatatccaccctccctcttaagggatctggggatgttttacctaaatgattcttactttctgtagggtacaaactgtggctttggtaattggtcttgattgttgagtttagaagctgggaacatggtaattctagcctccagtactctgctcaaaaacgtgcactacccagtacagcactgtttgtagcatgttaattcactttaagaaatgttaaaagtttgagggatctcattgttcttttactcttcagcgtgtatgatttattttgagggagtataaatcaaaacacattcttggaacatttaaaatctcttaaaggtattttttatgtgtgtgcttatcctggcagtatagaatactttgtataccagagctaatgacaacagatcttttagggtttctgtgttgtaacaatcgccactgggcagacagctgccaaacatcttacaattaatccgatccatgttggctttcgtatcctttttctttcagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacaggtatttgagaaacacccttacaaacagccattgttaaggttggggattcatttcttctgcacttgtgtgcctgtccagttatttccctttttaagtctccgaaggaaccacacagcgtagctacatctgacggaaacccaagagtgtttagagatgggagcacacgcttctcttggaatggagcattttcctgtttagcactggtgcttggggcgggggcagcagggtgtggtgatgaagaggctgactcgagagccaggtttggatcctagctgtgtgtaaccttgctctactttctgttcttcagttttctcatatgtaaaatgggataaaagtagtacttatttcatagggttataaggactaagtgaattcatatgtataaggcattaatacataagcattgtgttcggtattattattcatttgtttcttcagattttttttctgtgtgtgtccttggtagcaggcacatgctaggcactgggaattcaaagacaggtaagtcacaggccttgccctctgaggacagctcacaatctgtgatacaatgacagtgaaaaactatgtccaagggagcactgagaaaagacacaccaaaggatgtctgttttccaagtagtgtaatttcattttcctgtccctttagatgggaataattagagatatgtgtcctgtagcgataatatgaagatgaattaaatacaaagatgtagtcttaagtgagcaaaagaaatcctaggaagtactctcgagaataatgtatttgttaaactctgggtaataagaaaactactgcctgcttgtgattaaaagaaagtcattagattagagaacaagttttcccatctggtctctagaccagcatcagaatacattataccccttgggctccatctgagggtagctagatgctgatttcttgttttttcatcagattgccacactattggtatacaatttggaaaagtaaatataatgcagtatttcttatttaaatatatttagttcacattaatctgacaggacactgaaatacatgtctgtttttcataaaaattttttcacatgatatggtattgcattcatatttttagggtaaatcacatacccttgttttctaattttcctctttagaaatgtccatgttagaagtatttaagttgttttcctcgtgtaacataaaggatgttttatttgtttcaaattcatctatgtttaattttttttcctatggactacaaaagtgagagcatacaggtatactgacaaaaccaaacaaaaaacacctataattccaaccacctagagagaactcatgttaacacttcctgtataacctattagatcttctaagtttccattgtcattgcattcccagcaatgaattatgtgggacaggaaagaagcctctgagaagctgcagtaacatgtaattgtacactgtacctgtagccactttaccgatgcacacacagcaagctccaggccttagccggtagaaagcaaagcagaggaagcttaactctccagtcatttgaagatgcatagcttgcatatccctcagagaccctcaggattctctggacactggagccaggatgggaagggtgatcataagagaacaactggctcaggagtgtggggagcagtagtcttcatgctatagacatacagtttctgggtggagaggaggtcagcaggaaagaatgaatagacaaccactgtcaccagcacacctttcattttcatactcatttgcactatttcaaggcctttttgtatttattacaagttttatattcacagcattcctgtgcagtattatttgttatgcatattttatagataaggagacaaatagaaatgttaagttaggtagtggcagaattaggactgaattccttatcttttaattctcaatacagtgtcacttcaatgttgtctcactcccctaggttttggcagcatgatttgtctgttagaatagccaagctttgaagtttgaaaagaagggctgagaaatcactggaatagtaggccacatctaaggctaaactaataggggattcttagtccaagtatgaacccttgcaaagtcttaactgtgttaccaaaaataataggagcttcttaatcacaaactctaaacataaaacaggtatctaataaactttgttttttcttttaaatttgtaactgcatcttgtggatgcaacttttaaaataagctgcagtcattataatcttcttaagactaaaacctagataacctagataatatttataaaaaacgacgtcttcttactatatttctgtatgctaatgtaagtgggttttaggaccctctgaagccagaagccttaatgggcccagagggtcttcatgggattccttacattcattacattcacagttgaaaattctgctgtgttctaatgagaggctacatgaggatcagaaaaactagccactcagtttcaaactgcacctggagcttgtcatagatgcacaattgagcaaaatattcctttttccagactccaagtcatatcctgcattgcccagcaagctttgttttaggaacatttgtgtctgcatgtttatgctaccttgggtgttagtcaattcatagtctcagggaggatttctaaagttcacggaacttaactccactaaacaatgtagctaacattgcagagatcaagaaagtggcagtgacacctggaaaggtttcaaagaggtcaagatatcttaaaaccacacaagaggttgctaacaacagtaagtcccaataggatgaagagaaacatggacacaaccaattctagaaatccaaagctgacaaaccttttagaattgaaagtcataaaatgctccttatagtttctaacacatgctctggggcagaatcacttaacattctggatatctcacaacagtttcttgcctaaacaaacaaaggaagaagaaaactatttcctagggaataattgaatatattcagctgcacagaatcatagatgccatcacaaagggctcttaaatattccaattcagtagactttagatcaggttggatgagaacaataaccagcaagggactggtcttcaaagaagtatgtcacattatgctacgttgaatctagggaccagaagtgtgagtttatagaatgtttccccaaaatataggcagtatatgcagttcatagtcaagggaggctttgtttaatttagacaaaccagctatagtgacatctccaccaactggtaggatttatatagaggctgtttaacttccttttctagttaatagagagcactgttggttaaactgcttggaatagtattgcctttatcttgtatgtaaggatttacacttgcttttagcctcaaacatgtataatttatgggttatgcatttttttcagaattacagaattctagttaccaatgacttaattgtggtaatcaaaccatcaagcaagtggaaataggctctagacagagctatggaaaataataaaacatttatccaaaatgaatataacggaagtttcataagcttatgaaaaaatagcaaatatttaaaactacaggtcaggcatagtggtttatgcctgaaatcctaacactttgggaggctgaggcaggaggattacttgaggccagaacttctcaagaccagcctgggcaacataacaagacccaatctctataaaaaaacttaaaaatttaaaaatctaaaaattaaatttaaaaatttaaaaatctccacaaaaaaatttaaaaagtatgtgtggtggcacatacctgtagttctagctacttgggaggctgaggcaggaggattacttgagcccaggagttcaagaccagcctgggcaatataatgagaccccatcttaaaaaaaaaaaaaaaaaaaagcaaaatgtaacaaggtaaaattaattttgatgagcagcagagcatcttggaaatattcattaaacagagtgacacatagtgacaaaaatataaatcctatattactttaaagcagaggtggcaaacttttcctgtaaagggccagatagtaaatattttaagctttcaggatttacagtttgttgcagctactcaactctgtgtaaaatcagccataggtgatatgtaaacgaatgagtgtggctgtgtgccaatgaaactgtatttatgggcaataacatttaaatttcatataattttcaaacatcacaattactattcttttgattttttccatccatttaaaaatgtaaaaaccattctctgctcacaggctatccaaaaataggctacatgccaaatttggcctataagcctaagtttgccaacacttgctttaagacttctcagttgatcaaattcagtagactaaaggtttgatttaaaattgttttcactctgacctcactggtattcctatcatttgaaagcttggtacaaagttccagaaattgagaaatgacagataatagttaaaatctaacttctatgtaattaacctgtactcaccaaattacagaaaatatttttattatactcattctggtcctaatcagtacataacagaaagttctccaatttttgttttgtatgtaacaatattttaaaacgagacctggtaattttttcatttgtctaaaacggaaagcaacaggttttgagtatctgcctatcttttagtaattccagccagttgtcaatttcattaactagactgtaattcttagttactatgctttacaaatccgtttatataatgcatgtatacatatatatttagagaaagagcatatttcttgttgccacagtaacaatttaaaaacttaaaaagccgacttgggggacaaagaaatactctgtgttgccaaagctgataaatttttcaagtgttctcctatgtgtgcatgcatgttaaagtttgtttagaaagggcaaatgaatagacactattacacactggagttgctaatggaattggtactttatttctagaaagcaattgggtaagaaacttcaaagctattaaaattattgtagattttgacccagtaagtctcccagtagtaatctacccactggagagaaggcaaattaaaacaaagatttttataccataaaagttaatcacagtttgtcacaaaatatttaaagcaccaaaatgttcacttttaaggagttaagtaaaatctggcataagactatcttatagatattttatgggatctttacatttttacatggaatggaggaagtcctacctatcatatcatatcatataagtcagaaaagcagaatatgaaattctatgtatacaatgtgatcataacaacacacaagcaaatgcacaaaacatactggaaaaagacatgtcaaaatgttatcagtggttgcctctgaattttgggtaaggtgatattattctatttttgtcacatttttatgtacttttcaacttcttattaaggagaaagaaattaaatttgagacattaagcacccccacacacacacccaaaactcacatacagactaaaaggaacttcaaatattaattcttaggaacagcaccaagtgtaatgatatatcaagagtgattatctttattacttcttatacaaactattgcaatagtttttctcaattgttctcttagttaacagttttgccctgttttaactctgatttatctctcagactacagctcaagcaattttcctaaatactttgattgttacactttcctgtccagaaaccatcacatgctacaccatgatttattaaataatatccaaattatctgacctccaagggctaactcagtcttttcacaggccctcctgccattatttctctgtagctgtttatttagtctccctcacattcatttttttaatcagtatattttcatgtattacttattgcgtttaaatatatacattcttctaaggaacttactgtctattgagggacccagaaaagtaaaaaattattatagacatgacattgtctatcagtctatcaggatatcattgcagtagttcaggacagagagaaatgaggggtgaataatgaaaacactagccatagggaagaaatgccagggaatcaggaagtaaaatcaattgcatctggatatgaacaaagtcttaatgggaacccaaaggaaatgtttccaaatccaacatgaggatgggaagctggcaaggcttccagacagaagggatatttgtattacacgttaatgccttggagttagctaggccagtgaagtgagggtggaggcgatattccagctaagaggaccaacatgtgtgaaagccacagagacatgaaacaatatggcacagaaggataacttgactaatttggctacagtgtagagtacatgtgtggagctgcaagagggggaagtaggctaaggccatgagggctcctgtatgctgtgctaagaagttttaataccgtcttgaggccatgatagcacaaaggtgtgataatctacgtacccagagagatcaaagttagctttccacagaagctaagtttgaacagtaagtataggttggcccagcggatgacagtggaggagtacaccaagaagaacaagggaggtatatataaacagcaagttatggtcaagggatttcaggttttgtgcagtgtaactcaatcataaaaattgcagaagagatatgtgctggtccactggctcttagagtggtagtggtggggaacccctgattgtagggatggccaactttcatggtgtaaatactccaaagcttatttcaggctaccaatgggttgaccaccagtttgcaaaatctctaaacacttaattgctggttttcacaaacaagtatgagccagctccagcacaccactgtctggcagagttgtgttctcaagagcctgggaatccatttcaagaagatatacatctatgtgatgggcagctcttggctactgaatgagtttaagtagaggaatgccaggatcacagatgtatttcagaaaagttctactaatgtatttgagaagacggtctagagaagattgagaatacaaacagagactactatggtcactgctgcgtagtgcaggagtgagagagattatagtaactgagctaagacagagtaagggcattaaatgatataaatgcctaagaaactgatatttctgtgaataacagcaacacattctgaacagaacttaaaaaaaaaaaaaaaaaaaaaaactacctgaaggctctggagactaaacaaaggcagattttggaggggagtcaaaattttgagcaagtaatttgcaggatgactttcccatttttttggctttgccttgagggcaactgcagtcacggcagcacaggggtggcctatcatctttctggcccagggtaccaggggaaatagcctaggcatcctaggctgctagagtgtgaagagaaaaccctggagaggagaaagccataaaatgggaacataatatttttaaatgtagcccaactgttcagctgactgctgaaccacacacatgcatggggcaaactgaatgcagtttgtacccaaggcttaaagaagtaaactaacctgagctgctgctcacccaggtatgagaatttccagtttgagtctaaacaagttagttgcctgttaactacaaacatcaacactctttggagcagtcataagagaatccagattctccacaacaaaacatgtacaatgtccataatataacccaaaattacttgacagataagagtcagaaaaaaaaatgttaactcaatttccagggaaagacaattaatagatgctaatccaaagatgacccagatgttggcattatcggacatgtactctaaagtgtctgtgtcaaaggtgaagggattttacagatgtaattaaggtcctaaattagttgatttttagttaagagagaaaatcttgagtgggcctaatttaatcagattaaaaaccctaaaagagtgatcggacccttttgtaaggagagagaggcatagaggctcctgctggccttgggaagcaaactgtcatgttctgatggcctatgaagagggtcctggggcagggagctgtgggaggcctccagaaccggaagatggctgccagcaccaggcagtaagaagttaaggcccttgtcttacagccacaagaaaataaattctgccaacaacttaagcaagcttgagtagagtcttaccaagtcaagcctccagatcagaatgcagccaactgcagctcatttggagtcttatgaaccctaaacagagaacgcagctaagctatacatggactcttgaccaacagtcactgtgagagagtaaatgtgtgctgttttaagctgctaaattagtgctaatttgttacagagcaataaaaacataatagatgggccaagcatggtggttcacgcctgtaatcctagcactttgggaggccatggtgggtggatctcttgagtccaagtgttaaagagcagcctgggcaatatggcaagatcctgtctctaaaaaaaaaaaaaaaaaattaggcatggtggtgcacacctgtagtcccacctactcaggaggctgaagtgggaggattgcttgaccctttgaggcagagtttgcagagagctgagatcatgccactgcactccagcctgggcaacagagcaagaccctgtcgccaaaaaatttatatatatatatatatttggagacagggtcttgccctctccatatatatatatatatatatatatatatataaaatacatgatggaagaaaaaagtaaatttgaagataccaggaacatcattatgaaactactgaaaaacaaagataaagagaaaattttgaaagcagccagaggaaaacaacgcattacctaccacacattaggagaacaacaatcaaattactatggacttctctttagatactatggaggctagaagacagtgaaacaacatctttaaattgctgagagaaggtttaacttgatagaggtctgtttggaagatatttgggaggttaaaatcaccaggatttattattgatcatggaagagaagagtctggtttgactctgagatttcagacttaggtgatgtgttgctagttttgctattggccaagacagggagctgagtaggacaatgtttgagagacagagaatggggcagggtgtaagagcataacagagtaatcgtgacaaccattttggacacattgaattttaggctgctatagagggcaggaaggatggtatattagaaaaagcacaaatttgaagccataaatacctgagtttcactcctaaggtttgatagctgcatgaagagtggacagtttcttaatttcttggcacttcaacttcctcttctgcataattaagagactgttgtaaatattccatgtaaaacatttataaagttcctagtaaaggactcagcttggctgggtgcagtggtgcttcacacctataatcccaaaactttgggaggctaaggtaggaaagatagcttgaggccaggtatttgagactagccaggggcaacatagcaagaccctgtctaaacaaaacattctttaaagtaaaaagaacttggctctctataaccaagggttcctttttagtccttttcccctaactagacatccaaatggacatgtaaagtaagcaaattcgatgtaagaggctggagctcaaaagaatagtctgatctggagatataaatttggcctgttattggtgcctaactagaagtgggaataagtgagcattcccaaggagagagtgctaagagaagaattatctgttgctgcagaacaatgtacaatggtatacgataggcatacgataactacagtagacatttccatgtataaaagtaggaaacagaagacacacaggagtttctggtccatagaaattattaaattcaatcagataaatgttggaagtttcttaattagtactcagtattactcctgcttagaaatagctccccgttgctcgtggctttgtgcacatggctccagcctctgagtcacccattcttttccatgaaaagtagcttttgtttgcaccttgtagttttcccagcctgctttctgctggtagaattttgaaggttcagagtcctcttttcattttgtactgtctttatctctttcagtctaagttggcagtgtttctgccaatattattctttaaacaactttgtaggtctctttttattcttactgaggtttactatattagacaaaattaacacccatgtatcttttagataagcccttctctactttaagatttttctgatattactgagggacataacccttaagagtcttagaactccttttgtttgactagctctctgagccatcaatttaggtctttctaaggtctttcaaaagattttacaggcatattatttgcttcatatttagacccagcttttccaaccatgtcctggatttgatctttgctgggaagccatttcttgattttagcatcatttgcatctgataaagctaggaactttcaaaatagcaaatcctggctcctttttatctgacggtccttccttaagcttgtatctccccttgtgggttttaatattagcagcaggtagaagctaggaggcacttcaacactgcctggaaatctacttagctagatcatgtagtttattaggcaaattttctactttccatgttactgcaggtgatagtgttgaaaaactttctgccaccacatagcaaggatcccctttccacccatgtccaataacatttttcgcactctgtagctggcagtctcctgtagggccatcacgtttctattaataatctctctgaagtatgtagacattcactaacagccttctcaagttcttccagtttttactcactttccagctccaagcctcctccacattttaggcttttgttacagtagtatcccatttacagatactaaatctctattagtcacctattgctgtataaaaaattaccccaaaacttgagtagttaaagcaataagcacttattatcccacagtcttgttagtcaagaatttggggcatggtctaactaagtgattccagctcagcgtttctgataaggttgtaatcaagacatcacatggagctgcactcctctgaaggctcatctggtctggaagatccatctccaaaatacttacctacatgccttttggtaggaggcctcagcactccactacagggatctctccagagagttgctcgagtaatctcatgacatagcagctgctgtcttccagatcaagtgatccaaggcagaagccacaatatcttttatgtcctagcctcagaagtcattcattgttttatttgtaatatcctacacagatctgtcctattcagtggggggaacataaaggcacagataacaagaggcaaggattactggggctgtcttggaggtgagcttgcaaaaggatcagtagcagaatttgcgagttgggctgtgaaatagaatgtattgaggggaaataagagctatgaggaaaaccaagatgtcacaggaaaaccaggacataatggtgttttaaaatccaaaaaggatatttagggggatagaattatcagtgttgttaaatgtcctaagggaactgagtgaggtaagaattgaaaaaaagagaccattgtatttggcgattggaacatcattgatggctcaaggaaagcactttcagtagagagagggataaaagccagattacagtgggctaagaagtgaatgggaagtgacgaagtggtgatgatgagcatgaatttttttttttttgtcttaattatgtgttagctacagaaagccacaggtttaaggaacaattttaaatggaagagagttaggcacattaatatagaagaagaaagaaatgcgagattgatgatccagaagagagaatgactaatggcataaaatcttagaagggaagaaaaggaaagaattcatatcacgagtggaaggattgaccttgaatgggaagaagtttataccaaattttattgctgtttaacaaaccatcccaacacttattgacttaaaaaccatttattagctcgtgagtctgttggtcagacatctaggtgcactcaaaaggttcttctgtgggtctcacctggtctcacttaggaggctgaagtcagctggaggtcattcagggctgggtggtctacaatggcctcacccacatatttagtggtcagcaggctgtttgccaggtgtcttggttctcatccacgtgatctcaccaacaagctagccaagcttcttcacctggtaacactgtcccaggagaatgagagcagagactccaaggcctattgaacctgggctcagaattcacccagcatcacttccgctacattctgttgcgcagagcaagccacaaggttaagccagatccaaacagtaaggaactagatcttggtgagagttgctgcagagaatttgtggccatttgcaatgtaccacaatagtttcctccttgagataggagggagagaatgaagatggacatgaatatggttgaggttgtattggatgtttgctgagaatgaaagggaagaaaaagagggctttgaataaggtattgtttccacaatatttaatcctgtatcttgcttataatagacagctgataagtgttcctttatttttattattatttttttttttgagacagagttttgctctgtggcccaggctggagtgcagtggcacgtccacagctctctacagcctctgactccggggctcaagcgatcctcctacctctgcttccaaaagtgctgggattacaagagtgaaccaccacacccagccaataaatgttcattgaataagtaagttttgggatttctcaagaacatagatttaaaatcttaataataaaattgtcaacactgttctttgcataatgttggatacttttgtatatactattaatatacacagaaaagaggcactgatctcaaaatatatgcctcaatatactgtcaattcagttgggctcttaagagtagctcctggtcacacacccctccccttttcccattcctgcccctttggcctccttatggcctctaatgaaaaatcataaaataggaacatgctacaggaggagattagcaatatacttcaaattggccacaactttcatgtatgtctaactcttcacatttttgtttagccttttgtgcttattctatgaaaatttttgttgtttatcataaactgaaagtatatagtgtaatcactaaatattatatatttaaagtagatgtcattacaagttaaatttgccacatattgtctttctctaactgtggaaatagtttcccagaaatctacagtatcacccttattgttgtgtagggcacagctgtctgcaactagcagttccatttggggaggaaggattttatgcctttgctcccgagtggcagtaacaagcttctttttattgttgctgacattaagatagctaaaatcaacagtgaggtaaacacttcttgggaccatctggcaagcattttaatccaaaatattctgtaaacactgactccatttgagtacccaggaactaccgtccagccgccatcaactgcatttttatttcagttttaagcagtaattgaaatagccaaaaaaaaaaaaaaaaaggtagtctgtagggattccaggaaacttacattctctgagggagcttacagtgccttttgaagtcaccagtagaagtaaatggggtcctagcagttttggtcattaagtatttaatgcacagagcatatttggatttttttcattttctgttgggagatacattctacctaaatcagaggcagaagtttagggttgagttttccttttcctttatatttcaaagtttctttgtaaaactaatttataaaatgaccaatttcaagaattttaaagtctttcacaagaaatggcaaagataggattgtgatagggtcctttatccagtcccagggctgatttctggagttttctgcaagcctgcatgaaagagaatggggatatttcaagtgcaaagcgcccagaggaatggctgctggtgcggctaatggtctctctcttcctcccctggcaataaatctcagatattgaaatatagctttggagaaaaatatactgaagatttcttaagctttttacaagacactcaaagccttttcacaagccagtgctctgcaaatgtaaattcttgatgtctaaacataaaggtcctttactgagctaattttaaatgtgaattttaatacagagtacttggagaaaggtaatgcagctggcctattaaagcatggtattttgccatttttaagtaatgggaaatactgattaagaatgttataaagatttcagcatacataatgttgttgtctttaatcataacctgttaccatgagtctgtgtaacaaaagcattaactcagagacaatggcatacctattatactgtggcacttattatttccgtgcttttaaattatttccagaatattgaagagcttgttatttaaaggtcagaataatgcccaggacatggccaagcccactgagtgtcagatgcatggaatgttggatgacttcatagttataaaattatttcatttctcatgataattccggacttgccaagttagtgaattttaagaactctgagagcagattttaagataaatgtgaaataatccatacttctggagtcagggacttcccttcaggcattagttcatgtttgacttgcttgacttacacttggggataaaatgagttaggacaaggtcttagataccacattcccttactgggaaagaaaaccaacttgcacaactttggctggctcatatttcttgttatacaggcactaagaagcagcggttgccatgaaatactttatttaacctttacaaaaatgttttcttagtacagcaaggcagtttagttaaatgaaaataaataactgtaaaaattttggatttctcttatatccatctattgacttcttttttctaattaaaaattaaagataattacagttgtccacattgccatgatgactaaaaaatgaagtttatgtaaaaatcacttgatcttttcttaggacatgtgttggcatgtcttctattttacattaaactgaattttactgaatagtgaatgttacatctgagaacagtttaaaagaaagtttttattcaaactttaggtaggtttctctattgtttgtattttgtcaaaattgattttcaaacaaacaaaacctgacaatttgactcccagaatatttattcaaatccgaatgactaacagacagcctctccaatttcttatcttgttgctcccatttctcagctcacctaaattattcatcatcatttccttctaacatactgttaactctcccactgaagaattgggtctaaccaaatgcatgatcaccattgactatcattctgttaagagtttgtctgcatagcatcagaatctcctggttgttgacataacttaagcaatcaaagtcgtatttattttacttatttttaaaaaaagaaaatgtgaattatttcagattttatagacagtccctcctcttctgtatgtacatatatatcaaagttctttgaatctgtgcttttcaaccctttgtggtggtaccaagggtaaacagtcttaaggactgtcacacaattctagacttaaggcagctgttaatatcacagctcatgttttttcagtcacgtatcatttatagggaagcctttagaagaatgaaaacaatagatatgtataatgttgaaatgacctatttaaaacaagcctatttatcatttcatacttttttaactgtatttatatctgatttcatgattgaaatggtcaaaaaaagttatgcataaaatttaaaaatgaaatattttaatgcatgaaacatctttctcattaaatctttttgcaaaaatgtttatgcagtatattagttttccctaatttagttcacttagatttaatttttttttagcccagaatacccatgaagcatctcattgttttgtagaaaataatttaaatgaaaaatgctactattttccccacttttctttttttaggttattttacatatgtaaacttcagccagagattgaacagagaaaattcctgaacaataaaaatccataaataaattcttgaatttagagttgtgtttatagttatttgtgaaaaataataaaaagattctatggcttgattataggtatgttgaaacatggattaagccttaatgtttgctagaaacatgtgaaatttgataccctgacttacccagggaaattcaaatgactattacaaagtatatgatgaaatgacacaatgcactgttttaaagctatgaagaatatagatataacatatgagtagcattatttcaaacagccaaacagtgactttcttgtcagttactttgttccattgtctctcacgtatcaatccctggtgtttattgatgattgatgctctgagaggaaatagcagttactgacctaagagttcactttctcttcacccttccttcctatatctctctcccaccctctgtctcaagatttgacctcctaaaacaatgatttttttattccagagtgactccttctttccaaaatcaatattcagtgactccatttgggttacaatcaaaactattagaggaaagtaagctgacaagttgataatagaaagttaattttctaaattctgttgacaaaacaaatgaccaggagttgttttcacaaatagtttgaagccatagcttgctgcatttatggcttgtctttgtttctaacacagtcggtatgctttgtagacacaaattttgtgcagaaagaactactccctccctggttgtcacatgacaggttaggttgtcacctacttttgtttatcggaagtaacattactgtcatcttttgttctatttcaacatgtctttcttattttggggagtaagtaaaatacattctctggtccaacttttaacttccccaagcagaacacctcagaagccctatgtttttcttactctaaaaacattttgcagtgtaattattcttactgaatatctgtttatcctactatattgtaagcattttcagcccaagtgtactgtctagttcttttctgtacctaccatgtgtagtacagttagttggcttatagtaaacatttaatagctgtaaatccttaaaaatacttgccaaattgagccaggtacagtggtgcatgtctgcagttccagtacttggggaggcaaaggtgggcagattgcttgagttcagaagttcaagagcagcctgggcaacacggcaaaacactatctctacaaaagatacaaaaattagtcgggcattatggtgcatgcctgtagtcccaactactcagaaggctgaggtgggaggatcacttgagcccaggaggttgaggctacagtgagtcatgatcgtgccactacactcaagtctgggcaataaagggaaacccagtctcaaataaaaaaaaaaaaaacaagctgtggccctagggaaaaaagctcacataattgcattaaatggctcctaagaatcatgtgaatatgtaatatagcaatatagcaagccagactctgtgctaggaattatggagactacagagatgaactgaagatcatgtcaccctcttggcaaagtgccaagagggcaagttgggaaaatttggctttcattaggaggttgaacttgaatttttaaaatagaaatgtgtaatttctttttacctaaaaatgtgacctctgtatgcatcctattagacattttttttattttaataacatttttgtctgattgccaaataagacatagttgtaatacaaaatttggaaattacctgaggaagcacacaaaacacacatggaaaaaaggaaacttaaaatgcataatcctataaccctaaaataaccactgttagcattatggcttatttctagcctttttcttcctttggaataggtatacatactttttgtttatttgttttacaaaaatggggtgtactgcccatacctttttgtaatgtgtgtttttcaattaatctgttgttaactgatagcattaacatgttttcctgctatgactgtttttcagtcatttgaaagtgctctacagtgtaagtatagttttgaatagaggctctaagtaatttcagatcttttatctttcccttcccaacactctggccctgaagaaatcactcagcctctgtgtacctccatttgttttttcatctgtctaccttacaagattgttttaaggaataagtaatattaaaaatcacttagcccagtgcttgacacataatgtctaataaaggaaagctgtttttatttttactgtgttatttgaccaatttcctaatgctgccaaatttttattaaaatagcactgggataaacatacatctagatacattctttacacacatctgtaattattaccttaggatagattatttcatagaattgatgcatcaataggtattacaagtaagatttttttatataaggattacctttcagccacaatttttattccaaccagctttttatgaatgtgtcaggtttccctctattgtaagaggttgtttcatgctaattgcacagtatttgtggccttcagttaattcagataatcttgagagagaacttacagcacccatagtttgtggaagaatagccaacacttatatcacgacaatgcagcctccattatatcacaccctgaatgatttagaaaggctttctcagttgagcttactttctctttttctttttcctaccaaaacaaactacatcaaagggtccaaaaataaaattcagttgtatttatttaaacttactcttttaggtgggaaattatattctataaatgtgaaaggatatgcagggccctcagaattttagcattaaaagtttcagcattgaattgacaccaagcattagtcattacctagaaatttttctacttagtttttggcattatttcagataacgttgaacatcctgaaattcaaattccttgaaaaagcaataataagcaacatatttcatttttatgctaatttagtagtgtggaatgtactatcagttccacttagactcatgtattccaagcaagtgatttaatttcgattcaattgactttccagagagtattttggatagacaagaattattttagtattttaacttaatttttactcatgatgctcacctattgtatcattttgggcctacttgatattttaatatcagtactgcagtatctgaattatgaatctgagggattacactgacttggcgtttaatctaatattattatccctgtaagacaaatctgtgttgaaagatcattcaaaataggaaactcttgtaaatatcttgatttaatactcattttggtttgggttttgtttcgacattcttgagtttatttggacagacctggggtgagagggcccagcacctaaaagaaggtgttgggcctcgtggtgttgaagcttggcttgtgctggcgacgcaggatgccatgaggcagcaggaattcgatctcggagttgtagaatggcttggctgatggctggcagcacttgctggctgcagttttttctgccttcatgatctggattgagtgggcccaggcacagtacccagtgtccatgtcttagtctgcagaaaataggaggcagggtgaccacattcaccaggatttgggcatatggccaacctcctatcaagtatctggcacatcctgtttggtatagtaattgcctggggaccgcaactggggactgaattggggacggagtgactgcagtctctggccccaggaggcactcatactaattctgtgataccattttatgaacaaatatcaccactgacattttaagatatttactgttggttattttgtattaatcttgatttatttattcaacaaatatttattgaatgcctgccatacactaggctcttgggatattacgatgagtttagaagtttataaaataaatgggccgggttcaatagctcatacctgtaatcctagcactttgggaggccaagggggaagaattgattgaggccaggagttcaagaccaccctgggcaaaataacaagacctcatctttacaaaaaatagaaaaatttgaaaaagccaggcatggtggcatatacctatagtcctagctactcgggaggctgaggcaggaagatcacttgaggggtcaggatttcaaggttgcagtgagctatgatgacaccactgcactccagtctgggcaatagagttgactctatctctaaaacataataaaataaatggtgcctaagttttgatatataaataatatataaaaatatattaccagaatatatatatatatatacagtagtttatttcacttggattgcatgttaatttttaagaactcttaaaatttctacaatgaatacaatggattgggacattttttgaagttgtttaaatctccagtttctgtttagaacattacgtattactgtagggtaaattactataaaatgcaaaaaaaaaaatacacaaatgagtgtgaagataaaattttaatttgtgattattgaagtagaaaaaatcttgacagtagttttaaaatgaatagtgaaatatgtaacttcacaaaaaagtatttggtacctttatcatttatgttttaagatgcagtttaacattttttatttaaccatccactttctcttctttggtgtactctgttttcctagattttatcttatttttctttcctcttaaatatatcaattcaggaattctccctttggacaaaactgtaggtggtcctcagggctgatccccaattccctgatcagtaattctgttttaagttttattttgtatagaaaaaaaatgagttgaaaactgtatatgcttccatctgaggtcttcaatgggaaaactatgaatttagtctggctgccagcgcagctctgggggtctgctggaaaaaaagaaaatgtactctcttgggaccttccatcgagtgtggccactatacaacctgccttattgcttagttttagttgtcatcgaaaacttccaacaagaatagttcctgtttgacttttccccccaccgtggaaaatattagacactatctaagtagaccaaagagactgaaaagcctggatagattgaatgatggtaggggaagtaaggaaggaaaatcttaatagaaaagaggtgaaagaaaatttccaaattgataaaagaacacaaaaatgccctgggcttcaggcagaagggatagttattttctgtgaagcccattgctttcctctcccctgtatttctagcccacgttgcccctcatgcaactcctgcagtcttcctgcctctccacgtgctctcactctttgtcagcacattgctcacttatagggaagatatcagtgactatccactaattcctgcataaagtgcaaattccttagtttagtaaatcagtgccagccacaatctaaatctatgtatttaaccttatcctccaaccctttatccacgttcccttttctctcgccagttgagatggttaaccttgtcccgagcatgtgtactactttgcacatctcacattgtctttttggcatgggaaggaactatcatctttgccagttgaaatcctacccaaactctgagacccagctgcttcccaatgttttcttaatcacagcaacctgatccagacccttccttaactggactactatgtgactgctcctctcctttcctgactgcttcatgttagttatttgttcttgccttattttccctatgtgatcataagctccttgtggggcaaagaacatatctcttcctctatatttcctccatagtgcctagcatattaccttccttatagtacttgagtaatgaaaatgtgttggataatgatcgaaatctcatttgaatcaggtgatctaacacaaatgtcacatttttttgtgcctgattttatgcttccttctgtatagaaataaaaataggtatgcaagtatttgttactaaatggagacttacagtatctgtagcagtgaaatttagtcagtgggtccaacaagaacaaaacctctcacgttagctaggtgtctgtgcatatctgagcactcactgccatccagtgctcaaatccagtgccgcgggttcccaggcaggggtgattacaccatgggaaggaaaactgaagtactgctaggcctcctgaatttctttttgttggtttctctcaagaatgtagttcctttcctaatgaattatatgcatctaattgccaatgatatttagatgttttttaacagtagaccaaacattacaaatgttccattgattatgcatatgggaagaagtgttacaaatgcttttctcccacttaattttcctgtgtgaactaaatccaaacatatctgaattttcataattcaaagaaaatatctgtgccaacattctgagaacaaatagctgccaagcaaaacctgacagcatattccttggtgacatccagtctttaaaagctgtgtacacagagtgagcagctatctaaaactgagctcatatgcaaatgtgaacattcctcacttaaaattacattgtgtacattaaaactttctctagagtctatgaaatgttcaggaaaaatgtagctgagcttgatcttaagtaccttgcctcattatttttttttttttgtcatttctagctactagtctgtccaaagaaaacaactttcttatttcttttagttttgtgtgtaccctgagcttgattcccagttgctgctataaaaaactgaaagggttcccaacactgctatttttctttttttctctgttactaacatttaaacatcaaagatattctggtacttttatgttgtagagtatatataagaccatattttccctaaaggtatttactatccagggtgtgtttgtgtgtgtgtgtgtgtgtgtgtgtgtacgcacacgtgtgttttcttagctgttagccttttttagaagtcacctaactgatagcattttcctatcacaagatcactggcagtgcgtggaggaagaacttgagtgaggccatattaacagcagggagatgagttaggagatttttaaaaataatgtattcagatttaaaaaaaaaaaaaaaaaagccctatcttaacatcgaaaacgtatgttgtgatgaccttgggaattttttaaatttaagcatgttatcaggactcctcctaaggctgaaactaaaaactaacctgcttccaccaagacatttaatattatggcaatttccatgtaaatccttaatgtatttattattagggccttttatgatagtcttacaggaggttttcaaagttttattctgtctactaattgggagtttttcatgagatttacctttggttagctctgttaaaaaattatatgtgatatgaaagaaagatttaaattgtttgcatatgatataaatatatctttcttaaaatatcagttttcagccaggtgcagtggctcacgcctgtaatcctagcactttgggaggccgaggcaagcgatcttgaggtcaagagatcgagaccagcctggccaacatggtgaaacctcatctctactaaaaatacaaaaattagccagtcgtggtggcacacctgtagtcccagctactcgggaggctgaggcaagagaatcgcttgaacccaggacgtggaggttgcagtgagctgagatcgtgtcactgcactccagcctggcaacagagcgagactcaaaaaaaaaaaaaaaaaaaagtcagttgtctttccttgtacttacaaatcatagaacgttgttttcatttaaacctgtttcctacaaaagtactaattattattattttttggaatactcatatagttaaactgattttcttagctgcagttagtgggtaagagtagaaataggacatatatgaccccaaaacaaatccaaacatgaccagacatggcaatgctacatgaataaatataaatatgtatcaggaggctcagttggtaaatgttacaataagtacataacaaaaaaaaaaaagaacaaatacatcatatcttacatttaaaatgttgagggtatttctaatttgatatatctgtgatctcataaggaaagtatattaaatgaattgcatcttcaaactgctattttgttctttatcaaaagaaaaaaggtatgacaattgatgattaaaaaaaaaacccacaaaccaaatttagctttcattactgtctagccataagaaggaaaaaaccgtcagccaataccaaggttctttgatctcacgcttcaacctttttgtcctccagatgaatgaaatgatcttttctcaaatgttcagcaggccttttaccatttgataggaaaattatttttaagaaggtttaaaatgtgatctgaaaaaccacattgactctatgtgacatatttgctattcttagcctggtggaataagttggaagtggatgaataatgcaggttagaaagaaaacagatgcaaaatattacaaatggaaaggttttccagcaatgagactttcattttaggactaggtttttgttggcacgtttggcattatgacgattattgtttttttctccagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacaggtaagtttctttgtgttcatgacccagacacctcttaattattcagtgtaatggagatgaaaataattaataatttttttaaaatcacagtggttatgcctagttatatctactactaccatgcatgtgagcatttaataaatgcttatctatgatcctgacaatgatgatggcttcaaaccctttgtcccacttcttttacaagagctgctaacaagcagtaaaatttactgattttagtttcacctcttctccctgtcaccacctaccttctggtggaggtgctaatgagctgtgaaatagccaaaagtcctttattgagaaggaaaagaagcaaagagtagtgggaaccctggataatccaccagcggataaccaagagttggttctcatgcacgtgagaatgatctgtaaggaagtgctgtgatactctcccatgacagagtgggcctgggtctccagcaagcttttcttttcctaggagttaatattaactgcagtaaaaattcactgcagcctaactcttggcatataaaacctcagctctcagcacatatttttacgtattttataaaacttgctttttggctgtttttgaagttctaagactgcaaagggaaaaaagtatctgacactttctttttgttcttaagatgtgaaaatgtggtttctaaaagatgtttttcaagcatggacaagagtagaaagaaaagaaggaagtattaaaatctgaaaactggcttcactgcacacataataactggatttgtcgttagagtttcaacatatacatctggattgtaacagtctacccagagcttttgtgggacatgatagaaacagcacttagtccctggaaaaggggagcttcccctatggagcagcaggggctattctgttgctgcatgccaaggaggaatcaggaagctgctagtgaggtgaacagtaggacccacaccatatgcattcttggtctgcacctaatcaaggagctggacttggtgatcttattattgtgggccacggaaataaaaagagaactcaactctagcagaggagtctcagaaaagaagcatggaagactcttcccaattaactgagcattcctcagaatatttattgattgcctaaagtggaacaaagtaaaatggaaaacaccaagtatgtgaaacagtctttgcttttaaattgcaattttatgtaagcccaacaatgttgtcaactgacagtaagtgtaaagggaatttagaggtttcactgagaagatatgacttgagctgggctttggaaaatatgtagaatttggattaagagagagcattccaagtagacagtatagcataaacgaagagacaaatgtgggacaaatgagtcttactgaaggattcctgcagggaccggcctactagtgtgagcattgagccaaagagaacaaggagtgtcactaactcccatctgccctcagaacactcttacatgaatctgctgtcaatgaatatctgcccagtaagtgtatactggttttctgattctgtcactcatggtctttcaagaatgtcttacccaccttcccattgagtaatatgtctgagaaaaggtcatccagcctctttgaatagttcagatgacaagaggctcattccctcacacagcagccctttctgtttgctaccaccagctaagttttcttcctgatttcgaaccaaaaatctttcaccattccaccacctttccccattccctagaactatgaggcatatacaacaagcgcaaaacttgtgagaactccacaagtcacctctcctctacattatagcccttcaaaaacataagggaagctattgtgtttccccttggttttcttctctctaggccttctcaaatttgagtatgcatcagaatcccctggagggcttgttaaaacacagattgctgggtcccaaccccagagtttcagattgggtgtggtctgtaatttgcatttctaacaagttcccaggtgctgctgatgctgctggtccagggaccacaatttgactactatagctccagtctaaactttcccaggtagttcagctcattttagtgtggctgctagaacatttatcagttactgaaatggcagggtccctccatagagaaatggttttaatggtatgtcctcgtagtcaagatcataggcaacttggctgtatccgcttgctagctgtgtgatcttcagaaagtcatttaaactctgtgaatcaatttcctcatctgtaaaatgaggatagtaatagtgccctcctcaggaagttagtgtgaggattaactgagtttgtgtatgtaaaatgcttacaacgtgcctgccctcctgccatagccctatataccatatttaaaattactctaatgaaatgttatcaggcatgagtaacactaagttggacggttttgtattataacaatagtgactcattcttgaatagatactatatattttcaagaaacaatgttaaatttcagggataaattaatatatacagtgttcctgcacaaatattacacatcgcaacagtatacctaccaaatgtcataaaagttggttatttgaaaaatacatttctaaaaatgtctggcagttttacctcttccctgccccctcactcactcagatacacacacccacaagcaaaaatgttaaatgtctttttcaattggatttaatttttgctgtcagggtagtttagcgttcagatttgttctggttaaagtacatcagagacgtaggatttcctcaattggcaaggttgggaaggaagaagggaaccaagcttcagaagagctttgtggattcttgtctccctcacatcttggcttctttccttctaccccacctgggcctggaaatttgcaataaactgcagctgcctaattaccagggcccatttggggaggtgagtatatgcagatccctgatgcaccttaacaccccctggataatggagaattggctaaagctcttttcttaacattgatgctgggttatctgtgctctgcatttcttatacccctctcatttccctcaattgaatgaaaattgaccacagaaaattttgtgggaactttgtatgttctacaactactatgtacacacatttgcttccatgtttcccatctttttgttgaagaaacctttactactctaaaatctcaaatgtacacatgtatgtatgtataatggtgtctttatacacatacttttaatcatgtttaagatatcgttttccagtgcatctggtgctctggagttattcttcaatatcactattcttcttggcactgatctaataagagttctgaaacctgctaagtaaaatcatatgtggaaatcttcaatacacatctttgtggctttggggaaggaggggaattagtgtgaaacctggaaatgtgtattaaagagaaaccgtgcatttaaaaaaattaagtagctgtcttcaactgataaattaatcttgaaattctaaccataattttcaaaataaaggcattgtaagttttgccactttgaagaaaagcagatagagctctcctgagcctaaccctggaacagccgtgcaagcacactactccactgagtgaccatttttggattttctttcatctaaagtagccttccctccctggccacttttaagaattttcttttatcaaatttgaaagcctatttaacaggctttttagttgaaaatgagactataaaaacccaccaagaggatctttgtctttaaacaaagtgagtcccagatggttgtggagattctgtggtttctctgagaaacagccaaattctcttctaaatctcctggggtccaaaggttctgaagcaagagccatgtgcatatattgccaggcttgggcacatcaagaataacagagttaaataatgcttcagagttttcaaatgtttatttcaagttaggcaatgctatggcatcataagacttatcatgagtgtctagtaacccctagcatatgctaaagaaaagtttgcttcctaatttaggatcatagttcagttgacttttatggtttgttattgtgaaagcatagttttaaaagattatgatggctagagtatctaggggaaatacaactgttcagcacagcttggttttacagatgtgctccttctaaagaaaattcaaataagcagatagttgagaaataaatgagaaaatctaaacctcaccattcaaataatgcaaattaaaacaacaatgacatttaatttttggttcctcaatctagcaggtttcttttgattaaataatagttcatcccagcgtagtggcttatgcctatgatcccagcactttgggaggctgaggcaggagaatcacttgagcccaggggtttgagaccagcgtggtcaacatagcaagaccctatctctacaaaacataaaataaaatacattagccaggcatggtggcatgtgcctgtagtccaagctacttaggaggctgaggcaagaagatcccttgagccgaggagttcaaggctgcagtgagctgaaatcttgccactgcattccaccttgggtgacagagcaagacccccatctaaaaatagtgataataataatagttcatttataaatagttattcatatttattggtgtaaataatagttcattaaaattgatggttacagagaactcttgatgacataggaaaatgtatcagttaggacgctttcagtttgaagttacaaaatatgcttgttaatcttcatagcaagttaatgaggcagatactattctattttatgtttattgtttcacataacgaggaggaagaaggctggttcagtattggctaagcaacccagtgttgtatttgcttctctgtcatcctcttagatttgcctgcctggtctcaggtggcattaaagctgtatacatcctctgataacagcttctgtgacacaaaagaagggcttctcttctcaaactgtctcccttattatcaaggagtaatatctttcctagagccttttaccagtcttaccttctcatattattagccaaaccagagttccatgtttaccctgatcgatggcaaaaggagaatggaattaacaggattggcttgtaccaatcatgatacagccactgggggccaagggaggtgtctaccttccctgagtactttgctgccttttgatacctaaccaaatcaagtgagggtttttaacaataagaggaaaggagagaacagctattgggaagagaagcaatggtgtctgacacatttatgttataaagagcagcccttactttcttttttatggtttctaacttttcttaatgagtagatattaattttatgagagacagactatcagggtgatgatcaacaaactctgggccagacttactgggtaacaccaagcaagttattaaatatctctgttaaattttctctctgttaagatggggagtcacagtagcacctactttataaggttgctgtgagaatgtgttctccagaaaaaccgcactgatgagggggtgtgtgtgtgcacacccatgcatgcacacatgtacatgcatgggtgtgtgggaaaagaatgatttattataaattgactcgtgattatgaaacatgacataatcttagagaagtcccaagatctgcagtcagcaagctgcagacccaggagagccaatgtgtagctcccatctgattacaaaggccagagaaccaggagagcgaatagtgtaagttccagtccaaagtctggcaagttcaagacccaagaagagctgatgcttcattccaagtccaaaggccagaaaagaccaatgccctagctcaagcagtcaggcaaaatgagtttcctcttacttagccttttccttcgattgggtcttcatttggttagatgaagcccacccatggtggggaagacaatctgctttactcagtctaccaatccaaatgttcatctcactcagaaacaccctcacacacacacccagaataatgtttgactaaatgtctgctcataccatgacccaatcaagttgacatactaaaattaaatatcatatgcttagacttgtacatatactgtgtatgtgtgtgtgtgttattctggaaaaatattacaaataggaaattcagtatgtgaaagtcctattttctccaatcatggtgaatattcatattacagaaggatttgctttgtgaaagaattcaccaccgtattaaattttgcattatattttcaatttcaaccaatttaagaaaacatttgttgttttttgtagaaatagggtcttgctctgtcacccagggtggagtacagtggtgcaattacagttcactgcagccttgaactcctgggctcgagtgatactcctgcctcagcctcccaagtagctgtgactacaggcatacaccaccatacctagctaatttttaaattttttgtatagatgggatcttgccatgttgcccaggctagtctcaaactcctaaccttggcctctaccaggccccccatttgttttctctctctctctctcttttttttttttagacggagttttactcttgttgcccaggctggagtgcaatggtgtgatctcggctcaccgcaacctccacctgccaggttcaagtgattctcctgcctcagcctcctgagtagctgggattacaggcatgtgccaccatgcccagctaattttgtatttttagtagagacagggtttctccatgttggtcaggctggtctcgaactcccgacctcaggtgatccacctgccttggcctcccaaactgctgggattacaggcgtgaaccaccgcacctggccaagacccccatttcttaatacctactatgaactatactctcttacctgggtgtaaagttgaataacccataggtttagtggataaatctgtgtgtttataaagataaaacttacacagtttaggccaggcacagtagctcatgcttgtaatcccagcattttgggaggctggggtgtgaagattacttgagctcaggagtttgagaccagcctaggcaacactgaaaccccatcctacaaaaaaacacaaaagttagcgaggtggggtggtgcattccctgtagacccagctactctagaggctgaggtgggaggattgcttgagcctggtagattgagactgcagtgagctgtgatcatgccactacactccagcctgggcgaaagagcaagaccctgtctaaaaaaaactaaataaataaactgaataaaataaaaaaaattagatatctgcatcaaagattttgtattatctgtttatacagagatttcttactagataagagtgaaataaacccttgaaaatcaacttcaaggaatagattgatcacaattgccctctcagttaccagagctaaatgattttcaattcccagtcttttccatttctacttcacttgacaagattcactgccacctcctgggcaggcacttctcttatggcttcagcaaaactactgtcccctgattcacctctgttctccttcatcccttcttctctggccccattttctagcttttcaccccgagtctgcccttggagtattggtcagtttctgggtttgagcttctaccctctctttcaggtaaactatcttctgcttgtgcatgtttgcaaggctcttctttcactaatcattatctccacctccacattttctctggccagcacctgagcagcatttctaattgagtactggactcctacatgtctgtcctttaaatactgcaaactcaacatggccaaagcaaaatttcttcttgacttcaagtcttttttccttcttgtactgtttaagctaattacttcattttctttccattaacatcaacatagtttactctgtttgaatgataacatatttccagttaatgaagtctgaattgatgaagccttatatacttaactgtcttttagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtttgaaaagacgttcaatctagaatagagcagctttaccattgaaattttctcaaaatgttctttactcgtacagcacttaatttattaaaaagtgacatataaaaaaggggagtgaaaggctttgaatagtacttctcaaactgtttcctccccatcccacgacaatacatttgtatcagttccagtagttcttacagccaagactctgtccctcccagacgcaagtgatatcttgaaaaagattctgctgccccagggttaggggtagggtgggactgtgggggtggtatcctcctcacttaaggatctttatgatggtctgttactttatctcttcctcagtctttaccatcatcactttcattcccataaaggataaattctctttcattttgccacttagtcttatatctctccttatgcaaatctctttgtctttatggaaagagttggccccgctgactcactgcacatttgctttctgccataatgaagtctgtttttgctcagttttttttaataatggctttttccctaaactttaaactctttttaatcttccaaactgatgtatctgtgccttattttgattaattagtaaactgcttagtattcaataggaccctttgctatttcatgtgcaggtgccatcttcaaacagttccattatttatgtctggtgcacagttttgactttagaacccaactctcaagtgcaacaacgaatggtgagtgctttcccaatcctaaaatatggtatatgactctgacctttcctgttctgaaataaattaaggtcagagtgacccagggaagagatttattacaagtttgtttcagcatcaaacagctggaatactgcaacaaagcaaatatgaaagttgttctatccttttatttttatagattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaaggtactagaaaaatccttccatacattttacattttcctaggagaaattaagtagaaaagtaaccttgcactggggggcggcgggggaggggtgggtagggagatgggagtggagggagttttttgtatgatttcttatcttatgagaatgttattttaaaattgccctgcctagggatctcttattctcatctgtagttttagataaaaatcagcctttctcattaagcttagaaataaccagcagggatcatcagaacttttaatttaatttaggtttcattgacacatgacttctgtggtgaaagaagatgtgaatagagatcaacacccaggaattgaggggtgggggaagaaagaggaaaagccagggcccagatcatccacacactgtcccataaatggactctatctaccaaaaaggtgttggtctataatacatttgtagttagatatttttcaataaattatataccactttagaaatctgataattattcttggtttttatttcaatttcctagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggtaatattcttcagtgatctttttctacaaaaatttctcaacattaacaaatgatcattcacaaaaatattaaataccataagtggtgtgtgcatgtatctgtcagattcttaccttttatcatctagtaggtgtattttgtagatttctttattcatgatctagatcataattgcatgaaaagttgctttctcctgcatgcaaatttagcattgaaagattctggtatgaggaggtatcatgcaggagcatggtgtgtttggaatctttaaacatatttcacaaatattaaagttatcatatttcattgagtctcttggatgtggtttttggaacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggtactataacttttttaactaatacgaattcttatctctcaacaagtagattttattgtaaagttgcgtttatgatcttaacagaatgaatcagttgtgaaaaattcttcttagatgcatatgtaagaggtatggaatgttctttgatattcaaggacttttctgatgtcttttttttttaaccatcaacactattggtgcttgagttaccattaaatttgataacttggattagttacattcttatttccattgttataggatatttgacaagtatttgggctgctctatcagtacatattaaggaaatagagccatcatgtgtgcttatccataccctaggtactctttgctgttcttctggaaattctctgcaatctgcaagatattgaggatttcagagcaactgtttttgtcagggacccctttcctttataggtggacttggatgttcataattatggatgtctacccagttgattataacagtgtggaatgattactgacacagagagaaacctaattgcaaaacaaaatatcgcaggaaaattttatatttctgtcacaaaaccttctttataaggctagtctatttcaagaagacacacaaatctatttaaaaaatagagtaaaagtaactcctaaataaaatgtctttctgatagagaacaatttcagaatccttttttgagctccaggtcataaacatctttatttaattgcattttttcttttttctgtaaaataatcaggtgatgttaccttatggaattggaatgttgacctatgtggacctaatgttgcatattattctcttgtcaaatgagatgaaaccttcagtttttaaagcctttggtatttgcagggtagtcactgtttgggtttggttttcccctcccttccgtaaatacgaattccattgtgagtaaaaaaaaaaaaatacattgggagccaaaatagaatgtacgttgtcattacaaaacacacacacacacacacacacacacacacacacacacacacacacacacacacacacacacaccatggagggatatttggttaccttagtagacctattatataatattaaaaaaaaaatcctgaggattgaagtaaaaaatatcaaaggtaagaaaattactttataattgaggcattatttttccaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaaggtaagatcaaagtctatgtggctgggaggaaatagcatgccatccccttaacctgtctaaaatgaatctgcctttttctttttgatacctttttcatattacttcttctaaacaatttataacagtacatttgatttcttaacttcttagacctctgttttacagtgcttttttttctttaccagtgataaaagctgtgtcacataatttatccaataattgttctatttcagaatactcagcagtaacttgatttatagtatgtggggagaaaatgaacttactccaaaatatccacaaattgtacttggcctccttctttagagcagaaagtagagtcactaacgttctgagcatagagtgaaaggacaaaggctcctcctgcagcaaagtttatatttctggaaaggacatcctgagaaaaattatgtggatcaattctaattctctcctagaaccactgttatatgaggaagttatattcttgaacagtggactggtgtctatgtttttggagatgcatacaaaaaacataagtcatttaaatataaatggtatgtgcttttcagcataaatctaaagtctatgaaaacaattagctgaataatataactaatcacattatgtatgaaagtacaatatcatagtgtaccatgcagaagttttttgctgtacttctaatatcatcattattttagctgtccaaaattagaaaaagaagggatacttcatcagagtagtagaattcagattgacctttttcaggggagaagttagatttttgacaagtgtctttgaaaagtcttttgagaaaagttagggtcatttggtgactttttaaaaaataaatttccgtgataccaagaaattggtctttcttcagcattcaaggctggtatccatttcctcaaagttgtctgggcaacacatgtttatgctctgacggccaaagtactgtaacatgggtgtaaatggcaaagagctgtaagcatgaatcacccaaagttgaatagttgtaagttgagaactaccatcaaaacctggaaaaaatgttataatattcagtcaacacccaatacctctagcacctaacaaagtagccacagcaagtgttgaataaatgtttgtgaatcaatgaatgtactgttggaacacatattgatgtctaattatgctttggtagtgactcaggacctctttatactctttttagtctcaggacccctttatactcttaaaaattattgagaacccccaaagaccttttgtttctgtgggttatatcagtatttatcagattagaaattaaaacagaaacttttaaaacacaagaatatacaaatatatattccattagctatcacagtaataacatctcatgtcatgtacctctggaaatccactgtacgttcatgagagaattcaagtgtaaaagattaatagcatcttactattattataaaaatagttttgaccgtgggaccccatgcccagagatcccctgtgggtccccagaccaccctttgaaaaccagtgttctgatactattaactagatgggtatgtttaagcaagaaacatcttctctgagcatcagttccttacataacatgataaggtaatgaaatgatacatgtagtggttaagagcagcaccacagagccagactgcatgggttccaaccccctagttagaccctcttcatctttgtgaccttggggaagttacttctttgtgcctcactttcctcttctgtaaaatggggttaataatagtaactcccccacgtaggtactgtgaggattttgtgagttaatatgtatacagcacttgaaactagtggaacacaatattgcaatatatgaaggtcaatccttattgtcttcattgtcgtcattactgaagttctcagaactctccttggttcatcataggcattagtgaggcagctgctgggagaccatgaggaggaggaggaggaggagtgaggctgggtggaattctgccaagtaagatgagtggcatttatttacatatacatgctttctaaataaacactttgtgaggttactggtaaaataaccagaaaacaagtcttttatctgtcactacagaacagcagcaaaagtaacagggctgctaaagcaccatgttgtaggctaaatactgacaggggccagaacatttctgagaatgaaaggaacgccattaaatattctggggaaaaacaaaggtaaaattggtactgtcctggcagacaattagataaaataaccttttaggaatactcaagagattttgatatgccttacagtattgtcaaaattattttttctcaattatcttgtagttatgtcagttctgcatttcctccatggtacagcaaggtatacaaattattcagattgaagacaagactacaataatcaataatacaccatatcaaatattttataaaccacagctatctgtctgcaatccccattctggaaaggaggtaagcaaatcataacgattcttttgtctaagttttgataaagaaacaataaataggatcaacttctctttaacctatagcaaatgaaaagctaaccctgaatgtaggtaaagagaaattcacttatttttgttgtaattaaaaccatgaatgtcatggtcactgcttccaaggtaattaatgagcagaaatcctaccaagaaggaggccctgacacactgctggattagtcctgcctgtgccccatctgctcagaggctccagcctagtcctctagcatgctcactagactcctacaagcagagacatagtcatgaggactggctcctgggtcacatggaaaagcacatctgtctcacaggctgcagtgcctgggggagccatgcaggcaaaaggctagggcctaactgagccgtggatctgcgagcagtgagctctgtggttacaaggagaaaatgtggaaatgtactagctcatttatgttaacatcttgatggcagaatatatggaaaataaatctaagaatttcagttctttgaacaattaaaatgaatagttaatattttaagagaggagagatttttttttctctccattacatcttagatgttttccctttttttttttttaattatacttttaagttctgggatacatgtgtagaacatacaggtttgttacataggtatacatgtgccattgctgcacccatcaacccgtcatctacattaggtatttctttcttccctttcctccccctgcgacaggccctggtgtgtgatgtcccccctccctgtgcccatgtgttctgattgttcaactcccacttatgagtgagaacatgtggtgtttggttttctgttcctgtgttagtttgctgagaatgatggttttcagcttcatccatgtccctgaaaaggacatgaactcattcttttttatttctgcatagtgttctatgctgtatatgtgccacattttatttatccagtctatcattgatgggcatttgggttggttccaagtctttgctattgtaaatagtgctgcaataaacatacatgtgcatgtgtctttatagtagaatgatttatattcctttgggtatatacccagtaatgggattgctgggtcaaatggtatttctagttctagatccttgaggaattgccacactgtgttccaatggttggtttaatttacactcccaccaacagtgtaaaagtgttcctatttctccacatcctctccagcatctgttgtttcctgactttttaatgattgccattctaactggtatgagatggtatctcattgtcgtttttatttgcatttctctaatgaccagtgatgatgagttttttttcaggttttttgaccacgtaaatgtcttcttttgagaagtgtctgtgtatatcctttgcccactttctgatggggttggttggttttttcttgtaaatttgattaagtttcttgtagattctagatattagccctttgtcagatggatagactgcaaaaattttctttctgtaggttgcctgttcattctgatgatagtttcttttgctgtgcagaagctctctagtttaattagattccatttgtcagttttggcttttgttgccattgcttttggtgttttagtcatgaagtctttgcccatgcctatgtcctgaatggtattgcctaggttttcttctaggctttttatggttttaggtcttagtttaaatctttaatccatcttcagttaatttttgtataaggtgtaaggaagggatccagtttcagttttctgcatatggctagcgagttttcccaacaccatttattaaatagagaatcctttcctcattgcttgtttttgtcaggtttgtcaaagatcagatggttgtagatgtgtggtgttatttctgaggcctctgttctgttccattgttctatatatctgttttggtaccagtgtcatgctgttttggttactgtagccttgtaatacagtttgaagtcaggtagcgtgatgcccccagctttgttctttttgcttaggattgtcttggctatgcatgctcttttttggttctacatgaagtttaaagtagttttttctaattctgtgaagaaagtcaatggtagcttgatggggatagcattgaatctataaattactttgggcagtatggccattttcatgatactgattcttcctgtccatgagcatggaatgtttttccatttgtatgtgtcctctcctatttccttgagcagtggtacatagttctccttgaagaggtccttcacatcccttgtaagttggattcctaggtattttattctctttttagcaattgtgaatgggagttcactcatgatttggctctctgtttgtctgttattggtgtataggaattcttgtgatttttgcacattgattttgtatcctgagactttgccaaagttgcttatcaacttaaggagatttgggctgagttgatggggttttctaaatatataatcacgccatctgcaaacagagacaatttgacttcctcccttcctatttgaataccctttatttctttcttttgcctgattgccctggccagaacttccaacactatgttgaataggagtgctgagagagggcatccttgtcttgtgatggttttcaaagggaacgcttccagcttttgcccattcagtatgatattggctgtgggtttctcatgaatagctcttattagtttgagatatgttccatcaatacctagtttattgagtgtttttagcatgaaggggtgttgaattttatcaaaggccttttttgcatctattgagataatcacgtcgttttggtcattggttctgttcatgtgatggattacatttattgatttgtgtgtgttgaaccagtcgtgcatcccaggaataaagttgacttgatcttggtggttaagacttttaatgtgctgctggattcggtttgccagtattttattgagcattttcgcatcagtgttcatcagggatattggcttgaaattttctttttttgttgtgtctctgccaggttttggtatcaggatgatggtggcctcatgagatgagttaggtaggagtccctctttttctattgtttggaatagtttcagaaggaatgataccacctcctctttgtacctctgatagaatttggctgtgaatctgtctggtcctgcgcatttttggttggtaggctattaattactgtctctatttcagaacttgtttttgatctattcagcgatttgacttcttcctggtttagtcttaagagggtgtatgtgtccatgcattcatccatttcttctagattttctagtttattcgcatagaggtgtttatagtattctctgatggtagtttgtatttctgtgggatcagtggtgagctcccctttatcattttttattgtgtctgtttgagtcttctctcttttcttctttattggtctggccagcagtcttatctattttgttgatcttttcaaaaaaaaaaagcagctcctggtttcgttgatttttttttttttgaagagttttttatgtctttatctccttcagttctactctgatcttagttatttcttgtcttctgctagcttttgaatttttttgctcttgcttctctagttctgttaactgtgatgttagggtgtcaattttaggtcttttccactttttcctgtgggcatttggtgctataaatatccctctaaacactgctttagctgtgtctcagagattctggtatgttgtgtcttttttctcattggtttcaaagaacttatttatttctgccttaatttcattagttacccagtagtcattcaggagcaggttgttccatttccatgtagttgtgtggattttagtgagtttcttaatcctgagttctaattgcactgtggtctgagagactgtttgttatgatttctgttcttttgtatttgttgagtgttttacttccaattatgtggtgaattttagaataagtgctaggtggttctgagaagaatgtatattctgttgatttggggtggagagttctgtagatgtctattaggtcctcttggtccagagctgagtttaagtcctgaatatccttgttaattttctgtcttgttgagctaatattgacagtgggtgttaaagtctcccacaattatggtgtgggagtctaggtctccttataggtctctaagaacttgctttatgaatatggatgctcttgtattgggtgcatatatatttaggatagttagctctacttacattgatccctttaccattatgtaatgcccttctttgtcttttttgatctttgttggtttaaagtctgttttatcagagactaggattacaaccaccgttttttttttttttttttttttttttttttttttttttttgctttccatgtgcttggtaaatattcctccatctctttattttaagcctatgtgtgtctttgcacatgagatgggtctcctgaatacagcacactgataggtgttgactccttatccaatttgccagtctttgccttttaattggggcattagcccatttacatttaaagttaatattgttatgtgtgaatttgatcctgtcatcatgatgctagttggttattttgcccattagttggtgcagttttttcatagtgttaatggtctttacattttggtttgtttttgcagtgactggtaccagtttttcctttccatatttagtgcttcctttcaagagctcttgtaaggcagacctggtggtgacaaaatccctcagcatttgcttgtctgtaaaggattttatttcttcttcacttataaagcttagtttggctggatatgaaattctggattgaaacattttctttgagaatgttgaatattggcccccactctcttctggcttgtagagtttctcttggccgagagatccactgttagtctcatgggcttcccttgtgggtaactggatctttctgtctggctgcccttaacattttttccttcatttcaaccttggtgaatctgacgattaagtgtcttggggttgctcttcttgaggagtatctttatggtgttctctgtatttcctgaatttgaatgtcggcctgtcttgctgggttggggaagttctggataatatcctgaagtgtgttttccagcttggttccattctccccgtcacttttaggtacaccaatcaaatgtaggtttggtcttttcacatagtcccatatttcttggaggctttgttcgttccttttcattcttttttctctaatcttttcatgctttatttcattaagttggtcttcggtctctgatatcctttcttccacctgatcaattcggctattgatacttgtgtatgcttctcaaagttctcgtactgtgtttttcagctccatcaggtcatttatattcttctctacactggttatcctagttagcaattcatgtaaccttttatcgcggttcttagcttccttgcattgggttagagcatgatcctttagctcggaggactttgttattacccaccttctgaatctacttctgtcaatttgtcaaattcattctccatccagttttgttcccttgctggtgaggagttgtgatcctttggaggagaagaggcattctggtttttggaattttcagcctttttgtgctggtttttcctcatcttcatggatttatctacctttggtctttgatgctggtgaccttcagatggagtttttgcgtagttgtcctttttgttgatgttgatgctattgctttctgtttgttagttttccttctaacaatcaggcccctcttctgtaggtctgctagagttttctgggggtccaccccagaccctgtttgcctggatatcaccagcagagactccagaacagcaaagattgctgcctgctccttcctctggaagctttatcccagaggggcacccaccagatgccagttggagctctcctgtatgaggtgtctgtcaacccctgctgggaggtttctcctcatcaggaggctcgggggtcagggacccacttgaggaggcagtctgtcccttagcagagcttcagcactgtgctgggagatccactgctctcttcagagttggcagtcaggaacgtttaagtctgctgaagctgtgcccacagctgccccttcccccaggtgctctgtcccagggagatgggagtttgatctataagcccctgactagggctgctgcctttctttcagagatgccctgctcagagaggaggaatctagagaggcattctggctacagcggctttgcggggctgtggtgggctcttcccagtccgaactttctggaggctttgtttacactgtgagggagaaaccacctactcaaacctcagtaatggtggatgcccctcctcccaccaagctggagcatcccaagtcaacttcagactgctgtgctggcagtgagaatttcaagccagtggatcttagcctgctgggctccctgggggtgggatccactgagtaagaccacttggctccatggcttaagccccctttccaggggagtgaacgattctgtctcgctggcattccaggtgccactggggtatgaaaaaaaactcctgcagctagctcggtatctgcccaaatggccgcctggttttgtgcttgaaacccagggctcttgtggtgtaggcaccagaggcaatctcctggtctgtgggttgcaaagaccctgggaaaagcgtagtatctgggctagatagcaccatccctcacagcacagtccctcatggcttcctttggctaggggagagagttccctgatcccttgcgcttcccgggtgaggcgacaccccaccctgcttctgctcaccctccttgggctgcacccactgtctaaacagtcccagtgagatgagccacgtacctcagttggaaacgcagaaaccatccaccttctgtgttggtctcgctgggagctgcagaacggagctgttcctattcagccatcttgcccgggaattggtgtttttttcttttttttttttttgagatagagtctcgccctgtcacccagggtggagtgtaatggcatgatcttggctcacttcaacctctgcctcctgggttcaagcgattctcctgcctcagccttctgagtagctgggattacaggtgcccaccaccacacccagctaatttttgtatttttagtagagatggggtttcaccatgttggccaggctggtctcaaactcctgacctcgtgatccacctgcctcagcctcccaaattgctaggattacagacatgagccactggtacccagccgtaaggagaggtcttaagagaacttaaaaacagaaaatgttaagtggtatgctattgttttatactattgaaactgtcttataggaaagtattatctttctttacctttgtctgcacttttacctcctgctttcagctcctaaaaattatgttagattaatcaaataggataaaagtcttatacttttaagcttacaatgcattgtggtaaagtcagccctctgtctctgtaggttccatagttatggattcaaccaaacatagaccaaaaatattcaggaaaaaataaactaacaatacaacaatttttaaaatacacattttaaaatacaatataacaatcatttacatagcatttacatgttatcaagtattacaagtaatatagagatgatttaagttatactgtaggatggcacggttatatacaagtactacgccatttttgtataagggacttgagcatccgtggtattctcactgcttctaattatttcattaggacattctcatggggacaggattcataatattcccatgtccccaacccagcctctttctaaaaatacatagttatagatggtgtcttagaagatgtgctttacggggccaggcgtggtgactcacgcctgtaatcccagcactttgggaggccaaggtgggcggatcacttgaggtcaggagtttgagaccagccttggccaacatagcgaaaccccatctctactaaaaatacaaaaattagccgggcgtggtggcatgtgcctgtagtccctgctacttgggagactgaggcatgagaattgcttgaacccaggaggcagaggctgcagtgagccgagatggtgccactgcactcccgcctgcgtgatggagtgagactgtctcaaaaaaaaaaaagaaaagaaaagaagatatgctttaaaaagtttaattctgctgtattactgtagctaatgtgctctctgcatttttttttttttttttttttttttagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccaggtattttatgtttatataaatgtctgttcttctttgcttgtcagtctagctgttcatctagatgccaagagagatacaatggtcgcagggctccccatatgtaatattaggctttatttttaattacttctagacattgtatacagtgggtcaagtgttataatcacatatggcttgtcccagcatactacttaagggatttttccccatatggagcttacgctggggggaaatgatggtacttgtaccacagaatgtcattatatgaaaagatcatatgtatcatcatacaaatagcatcgtatgaaaagatcatatcataatgaaaaaattacctgttatgagttcttagcctccataaaattataagaaataagggttaaaatatgagcaagtcaagttggaagacctttttcttttcccatattttacttttacttcaaaatggaatttttctcaaaaaagtcattaagagagataacttagataaacacaagtcacagaagactctgttctgtggtcgttcctgcacgcaagttgctccaattaccgattaccagttatgcaaataacaaccacagactcaaaccagagacatataatggtttgttcatactggacttctattatgtggttgtcttgcatgtaaaatgtcccttctgcagctgtcaagaataacttagtatatataacagctacaaaagaaaacatattgtgcccttatgataagtaccttattttcatgattatgaatttgtagactttatttgagatttagcaatgctaactcttttgatgtaatattttaaaagacaagagagatttttttaatagtaatattttaaataagttattcataatggtaaggttctgttctccacacatccctccttcgttcacagtattcacaaaatccttgattttacaaacatttgtcatcttttacactgtagaggagtggttatccttacattctggttggagatgttaagcatagtgagtttaagggtgttttttgaaagctatatgaacttataataaataaaacattttttaaaaaacaaaatttgaaacaaaacaatttggaaattaagcttaaaattctgataattacagtataatttaatcttatctataaatactaagctagatattggacagaaagtaccatacttgagtcctggccctagccttcttggctatcaaaaagaagttatctgagtttggctcgcctagctgttttaaaattaggctgggaaaggaactttgctgtttatcgaagaactatactcttaaaatgaatttattttgtgctgtcccatctcctcatctatttccttccctcaatccaaccaacagcacacattagatggtgtgattaatgtgcttttaccaaatgctaatggaccattcactttgacatttcacacaaatacaatctttgggaagtactcacactggcaaatgagatggatggcaaatggaagctttttagagcattattgaccccttttagtcagctgagggccacatttggcaaattgtctgatttctttgattaattttggcaatcattctatgtaatttaggcttcagagtaatttcattttcctgcttcaaagaaatattctttgtggtagtctgtaatctaaataggaaaatttctctctcttcatcacagaaggcaacctttactcacacagctggttttctagctccaaataatacagctttgctcctgctaatcaaaatgtacattttttaaggtgtgatgggcttgtggaaattgacagcaaacattatcagcctgcctacctctagaaaaaaaagagcaagcacccaaattctctagtagtccttttaaaagaaggtcagctcttatttttattttttattttttttgatacagggtcttgctctgtcacccaggctcgagtgcagtggcacaaacacggctcactgcatcctcaacctcccaggcttaagccaacctcccaggctccagccatcctcctcccacctcagccttccaagtagctgggaccacaagtgtgcaccacagcacctggctaatttttgtattttgctgtagagatggggttttgcccttttgctgaggctgggcttgaactcctgggcttaagcaattctcctgccttggctcccaaagtgccgggattataggcgtgagccaccatgcacagcctaccaagcacttttaaggaagaagaaagtaccctgcctggcgaaggagtttaacacacatatgcatgggggaagaaaagaacaacaggaaatattagcacaaggttagctatagttctctctgggtgatagaattattttgtttgcctttaaatattttttcacattttatgaatattataaatatgttactgttatcagaaaaggaatctcccctgagttataaaacagatattttcgagttctgaatgttgcaaatctaaataaacatgttccagaggagagagcattcattttttttcctaaacatttctgtcatttgacttgattctcttccagggctatagtgctgacatatcaagaacacctcggagtgacttatttaaccctctcagaagaccctagtcctcgagtaattatccacaatagatgtccagtaaaaatgcttataaaggaaaacattaaaggtatgttttatactatcgaatttagataatactaaatgtgtattttttctgggattttttgatttagtagttacctgtgatcctgtgaaaaaaatatttaaataaaagcattaatgatctctttttgagaagtttcttttgccacattatgttctgtcccccaagtctctgtctttaagggctaattctgcatatgccttttttaaaatttcagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggtcagtgagccatgtgttcctgccaagacccaaagaaaaatgcccttttctgaggttttgtcagttgcctatttttaaacataattttctaaatgctgaacatcttttctctgtgtgagagaacatgtgtatccatttttacgtcctcattaagttataaattctcaaactcaagtatgtatctgcaaagtagactacacaatcattgactagagaggagcactagtaaaagcaggcccatcttggatctaatccaaggttgaaatggaaatcaaattgttaggcttatttagatagaacatagttcagctgtacagattttagtacagtcataatacaaatcctcttttgtgtgttattaggataaatatgtgtattttaaaattagtaattttaaaattagtaaaaccccacaaatataagtacagttttaaaaacctgagcagataaaatgtcttgatttgtttctgtcttcgtctggatgttagtgatactaattttgttgaaaatggcataagaacttagcatttcctttcttctggacttaaaatttaccatttgttagtgtataatttagtgacattaaatatatttatagtgttgtataaccatcaccactatttctgaaacttctttatcatttcaaacagaaactctgtacccactaagcaataattccccattctcccctcctccatcccctggtagctctcttcttctttgtctctgtctctatgaatttgcctgctctaagtatctcagataagtagaatcataaaatattcatcattttgtgtctggcttatttcacctagcataatgttctcaagtttcgttcatgttttagcatggatcagaacttcatttgtttttatgagtgaataatattgtgccatacttttttaaaaagttcttccacatttattagttcatctggtcttcacgacaagcttgtgaggtaggctactgtaatggttacaaaccatatattaaagttacaaatgcatttacggtagtaataataatggttatcattgaataatcacttacaccatacgaggcattgtgctaagcactttacattcattctcatctaaccttgacaacagccatacaagttagtgactatcatctccacggagggagaagtagaaactaagacctccagaagtaccttggtctaatttgcatgtagtggaagcaaaaggcctggaattttatccagttttgccagactgcaaagccggtgctctgagcacaatgcatgctgtttccttacatgaaaccccttggaacccctctttcccagtcctcctggtgcattttttctcatctctcaagatttcattaaagctcctgtgaagtgtatttgtgaaatgtggaatgactgatctgctaagggagagaaggaaaaagagaggggcctgagaagagcagtagctgtggaaactggtgaagggcctggctggagacaggggaagggatggttgagtgcactggagggccacactcaccctggagacctgcgtttgtagtggccacaaactactcaggggtgtgctttctatcagctgtgttcaggggctgaacagtgaaaacccgcgggatctgtgcagcctcaggagatgctcccagtctcattaatttacaaaataaatattgcaagcttctcaagggtctctgaactcccctgcatgggtttgaagatttttgaaatcttgcttatatttgactggggaattctttacgatagacattcttcctgtcaaaccttattttggggattcccattcactctaaatttcctcaaaactttgtagtcagggatacttcaaagctaagaggaggtgctctttccaacacccttatcatctgtggtttgaggacccagcagtctcatgttcccattaatcttttaggagctgtgtgccatatgtcctgcagaccgtggtttacttcctactctggaggaagatttgtttcagaccctcaccgacatctcctcagtaatatcccagggcatataaatcactgggaagcaaaaggagctgtgtcctctgatgaaaggaaggagcagtccttctggaggagggagtttgtcttccaggaaccttcctcagccattggtctgtgaatttcaaagctgacctaaacaagcaaaatcaaaacaccataaaatgcccattatgctgcaaggaagaaaactcctttaacttttttcagtcaagccctctgcttccattgtataaataagatagtctcgtgttgtagaattttgaaatggattgcatgaggaaatatgcacataggagttgtatactctcacagagtattctttggaccaacagttattgagaagacctgctaacatgtaggctgcagaataccgattgtgaagttgctgtgggctttctgtggttgaatccctggctcacacctagtcaggagacatctcatggttattcaaccagagacctgaaggtggcacctggtgctcatacccatgatttgatagttagtggtagcctgactttaggacaaaaacagtctttaggtgctcaataaataaagtcataaaagtaagtttacaccaataattttaagtcataattttgatcctaccaggaaaatagttcagactcctgtcatagtgtataggattttaatttctgatactctgaaaccacttttgtcagaattaggcaacattattttgaaaaagtcaaaataaggaacaaagaaaacatagtagttaccacttaactaccaacaacattgagaagcctgcttcattcattcagtcaacaaatactgagtttctaacatatgccagacattataacttggtactggcaccatgtaaaatatactgaacaaaaatgtagcacagcccctgccctcaagtttacctgtggaggagatagataataagcaagtaattgcacgggtagttgtattataagcactacaaagagctatgcaggaaaggtacagttgtgctatgtgggtgtacagcagacaagtttgagaggtcaaggagggtgtctcttactgagagaccttgcctctgtgccttcaaggtgaacaggcactccctaggcaagagagtagggaatctttccaggtagaaagagcaatgtgtttgaagcttcagtgttcagagggcacgtggtcctttcagggaactaaatgccagtgcggctgtagcgccaaatgacagagggtcggagagagggctggtgaggcgatgagagaccaaacctggcaaggccccgtaggtcctatcaaggattttggttttgatcttaagagtcatgggaagtcattgcattgtttatgaaaagtacttgctgagccactgaactgcaaagaatgagtagtttgaaccccagaaagtgaattaaaatgacccctttgcaggtaaattcccttctgaaaagatccagtaaattctcatgatctttgactcttagcagacattcgtagtcgggtcagtgtcactgctgtttcttcgcaaatggattgttttgtggggaggagagaatgacagtccttcatgtttctacagctctgtgccatttaccaagtgttttcacaggcacagtctccattcttttattcatttgttcaaacttttactgaggacctatcaggtgccaaaccctttgccctaaataaggcacaattcctgccttcaaagacttgaataaccaataaatgcagtaaagggaagataaagcctttgatcactgcaaaaattctaagggcaataagttttatgtctatttactgatgagagatttgaggcttaaagagtaatcagctaggtgacttgcaactaagcaggagcaagccggagcctaaatctgctcccatgtggtctagtcctgtttttcctacaccaggctcaagccactgtctgtcctctgaagtcttgccttggctacaaatagtagctgcctgaaagttcatcaaagcacaggttagaagagattttctgatctccgcattcacctaatgcaagaatcccttccatgacatctcaccccagaaggctcccagtgtaatagtcattacttatccagtggtggctatgagaaattttcttcttgtatcaatctgaaaactattactctgtagcatccattcattcatctttgttttgccctctgggacatcacagattgtttatttcccctcaaatacagcaacgctacaattatttgaaggcagctccaacatctttcctaagtgttcccttatccaggccaaacatttctggttccttgaatcattccttcagtaaatgcaatttccacacccatcaccacagttacccttgtgtgaacactctagtgtgttatgttcccttttaaaaatctggcagccggaattacacacagtattccaaatgtggtctaaccagctattaactccctatgcttccattaataaagtaaaagatagagttagctttttattaatgagttcagactgtctgttattattgaacttgtggtcaaccacatcccccaggtctttatcatatgacttgctatacagttgactttttgaacccaaagacaggactttacatttatcccaaataaattaagtcttgttgatattggcctagtccagcttgttgaaatcactttttaaaaaattgtgatgctgtcatctaacatattaagtattcctggtagctttatgtcatccatagatgtggtgagcgtgcattctacatgttcatccaggtcattaataaatatgttgaacaggacaagttcatggttgacatactgcagtgaatcattagacacttcccgaatgcatggggtcaatcagccagactccactctcatctagcccatgtttcttaaataagaaaatgcatctaaaatcacttttaaactatacagtataagatattatctacaagaatatcagaacatactttgttaagtgccttgatgaaccaggactcaaatgtgtaatctgtccatttggtgcagatcacacagaggtaaccttgaacactaaagcttaaagcagcaggtagtaattttcagagttatgtctaccctccaattcaggaatttttataaagaaaaaaagtcagtgcaggtgaatatctgatttataaaatgtgtaatgcaggtattttgacttcttgcttacttcgctcaccttcccagtactccagggcacagtcgaacagataccagcaagttggcactgacttctgaatgtctgctaggtaccctggtctagagtctcctctgtgtttacagtttgttctggctgagtcacaactgtttccaaagatactcaggagtagtgatttccctaagatgtttttcaagaagtatacagtaggaaaaattacatccagaatatccactgttttcttttcatctctgtccaatccttcctaccttgatcaacttagaaattcatcttcctttcttctcttggatatctaattcacctcatagctttagctactgcctgtcacccagtcactcccagaaattgatctccgggccccatattactcccagtgtacaaatctgtgcttctgcctacccactagacatgtcagcctgaaaatcctacaagcatctgaaatcaacacatctgaaaccaagatgatcatttttcttaccccaagccagcttcttctagagtctctgcatcagttaatgtcatcactgttttcccagtacaaaaaccataaataaaatggattcagataatattgaatgcctgttttatctcaagctctctaaaggtatagtcattagtccctgtcacatcctttaaaagtagatgctacccaaagctctgagaggtgaacttgctcaggataaatggtcctgggattcaaacctgggactgtgtggtttcccagcctaccttctgcctactgcttctcagtgtcttcctttctctctgatcctccacacatccagtaggccaccagcttctatcagaaatatctcagaaacgtctctggaatctgcccctttcttctgtgactggggtctgcttcaggcctttggttcatcatctccctcccagattttagccatagcgccttaataggtctctccattgtcagcctctccaacctcaagtctctctctgtaactaacccccaaatgattcctaagacacagactccagcccagagaagagaacccagtccaccaggttgcttaaaacagacctccacctgagaccaatcaggccccgtctcactcctgttccccctctacaggccagggctcaatcacctcttcccgcctttcaaagtctaagtctataattcttccatagcatggtttcctagttaagatactcttttacaaaccacatatatagagatatcagtagtacattttaaatttattccttcccaaaatgggagatgatattttttgtaagaaatgacttttagcccaaagtcagctgcacaaataaaatgcctaagtagcatattttcagatcagtttagacatatcaacttgcagcaaaagatgagtgtgatactatctgcaacttaaatgttcaaaagtagggagactaggtgcaatggcttatgcctataatcccaacacttcaggaggctgaggcaggagcatcacgtggggccaggagtttgagacccatctgggcaacatagcaagaacccctgtctctacagaaattaaaaaaaaaaaaaatcaccaagcgtggtggtgcacacctctattcccaactactcaggatgctaaggtgggaggatcacttgagcccagaagttggagactgccttgagctatgatcacgccacagcattccggcctggttaacagagcaaaacccgtctctattttttaaaaaaacaaaaaacttcccactattttctttgtcaccttgtaattaatttacttagtaaaattgttataattctaaaaaatttgttacatataaataatcattcaaataaagataactgagtacatagaaaagcagaagttatattaaaatgcttcttgttagtaattgtggtagaagatattgtactaagtagaaaccagtatccaggcctcaaatggttttcttagacctaacatatgtatgatggggctgagcacagagacttatgcctgtaatcccagcactttgggagattaagacaggcagattgcttgagcccaggagtttgagaccagcacgggcaacatggcaaaattctgttgctatgaaaaatacaaaacttagctggacatggtggcaaacgcctgtaatcccagctactcaggaggctgaggtgggaggatcacctgagcccagggaggcggaggttgcagtgagccatgatcgtgccacttcactccatcctgggtaacagagtgagactgagaccctctctcaaaaaataaatatgatagtgtcttgctgactgaagtgctctaacacagattcaaatggcaaaacggtgagtctcttagtatatgtcacctagagccttccatgccaccccacctcaccctactagtgaagaaagtaaaaagaaccaaatgatggcattgatcaggactggccgggttattctgtgataacaaacagctgaaaaaaaaatccccttggccatcagtcattaattatttttttccccacacacagaacaaatcttccccgcaaggttggaagcagtcactccatcacccttgaagtctagcacttctaagcgatgctcagtctgtatgtgatgccctttgatctggagacctatggaattacctgctccccctttccctgctgttttataggacagggtaacagtaataacccctccactgtggaagggggaagaatgagagacatacggcagtctcttgcctatggcagttctgaatgttttctgggcacatattgtggggtctataccctggcagcaagaaatcagctttcactgagcactgtttctaatcctgaaggagctcttaccattgtccttcaggttcctggctccaccttctgggagatcttccttggacacttgaagtttgtgtttcatctcacataatcacagtctcttttactccaggtttgtaagtatatagggcagtggtaatttctcaactcagtagacttcttacctatttggttccagaaaattccctgtgccaggaaccatattcatggtccttaagacacatttctttgcttacttgcttccttcctctctggatttaagagagcttctacaggaaagttatacccttgatttacatttttttccaagtcaatataacagttaagttttaacagtgagtgtgttgcctatagtcagtcttaaggctgagtgttaatctgccttcgtgttcagaggctaagtttagaccttgctatttgaggctttatcttagtctgttcaggctgctatatcaaaatacctcagactggtagcttataaacaacagaaacttattgtcacagttctggagtctaggaagtccaacatcagggtactggcagattcggtatctggtgaggacccacttcctagttcatggatgaccatcttttcactgtaacctcacatgatggaagggatgaggggctttctcaggctttttttttttttttttgagacggagtttcactcttgttgctcaggctggatggagtgcagtggcccggtctcggctcactgcaacctccgcctcccgggttcaagtgattctcctgcctcagcctcccgagtagctgggattacaggcacccgccaccatgcccagctaatttttgtatttttaggagagatgaggttttaccatgtgtcagtcaggctggtcccgaactcctgatctcaggcaatccgcccgcctcagcctcccgaagtgctaagattacaggcgtgagctaccgcccccggcctcaggcttcttttataaggacactaattgcatcccaaagaccctgccttctaatatcatcacattggggggctagaatttcagcgtatgaattttgggggaacacaaacattcagaccatagcaggtttaaaattatttctaactttgcaaggttctacatttctggaatctctctattatcttccatttttatttgcaacctggccaattctttcctgagctcatctcttcataaaacaaaacgtaatgttccagacacaggcaacagcagccaacataacaccactgatgcttggttttcagacctcatcttctagagctacagatttatgaagtttatgatctacctctcaagtcatctcaagcaacagttttactgaatatcttaccacttcaaaacatatatgcccatttttatagctttcaatatcgatttctactgtctgaccattaagccagggtctcctgttgtaggattttgctagaacactacttctatcaacaatatctatattagtagtataagctcagttatgctgcctatcataagcctagaacttacctcttgttcatgctaaatgcctagtgtgtgtcctcagggggttttgttctacatggtcactcagggacccaggttgagggaaagtccatcatctcgtatcttcccccttgtaactaaccaccccaaaacctactggcttaaaagaagaatgattaacaacttctcaagattctgaggaagtggccaagtgacttttctgcaggatgagcctgggatcactcgtgcatctgcattcacctagagagttggctgaggtatgggtgcagctgggaagtctgggtgtctctctcaccattctgtctgtcctccttaaggaggctagcccagggtggcaagcaggaaaaccccaataagcaagctgtatcaagcttcttacttgctgatgtcatgttagctgaagaaagtcgcatagccacgcccaatgtcagtatgggaaggtactacacaagggcatggatactgggatgtacaattcattgtgcaacagtcttccacagctatctagagcaggagtcaacaaatatttttttaaggtctggattgtaaatattttaggttttgcaggccttatgttttcccgacttctcaatagatggagagatatgtaagtaaatgagcatgttccaataaagccttattcacaatagcaggcagtggaccagatttggcccaccactgagctgtggaacataaagcccttatttattctctagaaggaatacatgtcaattctgcctttagcccattggccaaaactagtcacaagaccatatctaactgcaggggtggcggggagtataatcctgctctattcccagaaggagagaagagctagacatgtgtggacactagaagtcaatacagcagaagccacattgagaagatgtatgttcagatcatcagctttatctttattgagtacccggcactggttgtaagtactgaagaaaacacacacaaaaccattgccctcatggaacttacacagagtccatgatggtgaatacactgagagggagacgcattttatacacctgtggtctggaattgttagttgtcatctcattgtttgtgtacttggctttttcgccaactaggctgtgagcagtgcgagggtaggattgcatcttctctgtgcctgatgcagtgactaattctttgtaggcactctttaagtgtttgtcaagtaattgattgttcaaaccattagaccaagataaggatttactttggacttgtggggaacctggatatagatgcctaattcctgtatcactcaggtacctaactatctaacccctagagctgccatcatgcaaaaggctacaaggtgtgagttgtttctctaaatgtgaaaagacaaggatagactaaagtctgtgtttcttccattcatagcagtgagtgaaagggacaacaagcaaaaatttccctccagagtctaggttttttgccagaagaagtaccgtgaaagttcagattaatttgcttgccttcagaaggcccttggggcatttaacagaaaccatcaccttaccttaggtttattatcttagaaagtgtaagtatcctcatttcataatgcctgaaaatcacttagagaagagaacagtaaatatttctctattcgcatcccctccctctctcctctaaggggtcctgaagttatggacggtgacttaggaaaaggaatatgagatgggagcatgggacttaaaaaggtttctactgaatggataatttcatatctttcaacctagtaaagaaaagcaattgatttaccttatgtatcatacaaagggatggtgtttatagataggaatatttcttaaagaatatctcttttgttttagattcatgagctgagccatttttaagccattaattatgtttattctcaaattttattgtaagtttaatttttaccttggaacaaatagggcaaattcagaatacaagtcttttgaaaaagatatttttgcaaaacagtccatttgggaaacgtgttcatagagaatacagatacaacaaatggactccatttctgctgtcaagagatttacaatctaataattgggtcagacacataagtaactgtagtacagacaataatatttttgatcaaatagaaatatggttaaaattgttttagaatgtagaagtaggtgtcagtccagaagggaacagaaaaattaaggaatggctctatggagtaagctatcctttaagctgtatgcaccaggacatacaggcttttgaaaggacttatatggagaaaagtatattctaggcgtggtgagtagtgagtggcaggcaagggcctcagctgaagcagaggctgtaaaatgaaaaagaaggcagcagtggaagaaccaggaagagctggaggggctgggctgcagcaaggagcagagggagaaggcagagatgacatccaggtaacctgcatgctgaagatggtcagaaattctgaatttctgaagtccatgagaaagccattgcatgagaaagaagaccagtgaccttgaagttgcttccaaataactctctggctttctcctgtggttctgtgtacactctggtgcttcttcatgtgatcaaaattagaatatattcattgttggtcaagcaagaggccacctttgttccgtcatccaggaattttcagtatgtctgattttatttgctgccctaataataacatagggcccagacttggactgaattgatactgcaaatcatcagaaccagccttcccaagcataaggaggtttttgcccctaccctcaggtaatcctggctgtgaacatgatgttcttggagttgttttttaaatagccctgttctgttttcaaatatttacccatttaagcaactcactatttaatactgaaagggtgtttgttccactgtctggcacctggatcctgaggtagagcttttttctaggtcttagtccatattctcatggtagaaaaattaattttttactccgagcaaattaacttatatctaacattcttgttacgagttacatgaaagaccctagaggggttgtgatatgctcctaggtgggttttgaggtatgtttttgtgtccctagcccagaaggacacccctatagaagtaagtcaacacccaagagcctgaaagttgtttgcacattgcacttcaagtcccaagttttagtttttttcccacaaagatccatatgcacacatatagtgggccccatgtctgaactccagcccacacagagttacttgccagttccaaagaagcagagaatgaagatactcatgccccatcatccatcatttttttctatgaaccttacagctgaatattgaaaaatctggttttgatcttttgggtattttttttcatttcaagtcaactgaatagcccgtacacatggatataaagaaatataaccaggaattgtttgtggtattgaatcagaactggagacatttgaagtcaagccacttcaatagtgtttcttatttctttttaatcagattttgaatattctttctgcaggttgtgttcctgactggctttggctatgtgtatgtggatgttgtacatcagtgtggcacagtcttcatcactgtggccccagaaggaaaagcaggacctattttaaccaataccaacaggtaggtttaattattttcccagtgacaacatagtaagtgttactgttacaaagttgtaaacttagtatttatctttgtcatctccacataatgtattaaagcttttggttaattatcatgtaatccataaaaaatatggttattagcactaaatcatcccttcaataggtagcaataaaccgtctttcctagataccacttgcactccttctgtggtagggttaacaaactgatttacaaactatgcatcttggaatcataccactattattagcatgaaatgcacattaatacctctgtgtctgcatgacagtgtagtaattaataataaaacttagcaattagagctacatcaaatataaatacgcctcttagagccatattttccaccccccactttgacctgaatgttgccatcaggttttaaaaacatgaaatagacaaagagttaatatccttaatttaaaagaattcacataattcaataggaataatataaagatggccttacagaaacaaaaataggggcaataggcatgaacagaaaattctaagaagaggaaatataagtaatcaaagaaatgctaatttatcaaattaacaatgatgttgtatcatatacagtcctggtgaaagtataaattggtactatttccaatttataagcactttggtaatacatattaagagctttaaaatccttttggcttagaaattccacttttaagtgtgttaggagtttcagagttaaggaaatggagaagtgggcaaagatatacacagagagatgtacacagtgagagatatcacacagttaattacaatggcaaaatattcaaagtaaaaatgcccatccatagggaaatagatgatacataattgtactataaatgttacaactgcaaaaagtagatctcaaagaattttaatggaatagaaaatgcatattataatctaaaataaaacaagtagaatataatattgaatatatatgatcctagttatgtgttatctgtacatacatacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacatacataagtacgcatgtatgtacttatacatacataagtacgcatgtatgtacttatacatacataagtacgcatgtatgtacttatacatacatacataagtacgcatgtatgtacttatacatacatacataagtacgcatgtatgtacttatacatacacagaaaacattcctagaaataagactgaaaagaaaaaaactcaaaattggtaacagatgtggggttaatgagttatttaatatgtaattattatttgatttctgtattttgattatttataatagcatttattttatgatcagaaaaaataacttaatattaaaatataaataccaccaactttcatacgtttgtttaaatctttcttttaaaaagctcattgcagccaggtgtggtggctcacacctgtaatcccagcactttgggaggccgaggtgggtggatcacctgaggtcaggagtttgagatcagcctggccaacatggcgaaaccctgtctctactaacagtacaaaaattagccaggcttggtggtaggcacctgtaatcccagctcttcaagaggctgaggcaagagaatcgcttgaacctgggaggcggaggttgtagtgagccaagatcatgccactgcactccagcctgggcgacagagcgagactccatcttggaaaaaaaacaaaacaaaacaacaacaaaaaaagtttattgcttctcatatatggttaagaactcattaatttggactctgctaatttgaatttataatatttcaaacaatgttggatagaatgttttctttgcccaaaagtgttcataaaaaattaatagcataacaaaattgaagacgaacttttaactagtatagcacaaaatttcgggtttattcaacaatttcagaaacattttatctagggcataaatgttaataacaatagaagcaaactttcatgagaaaggtacaagtatttcttggaatttcattcattcattcaacaaatgtttttcaagggcttattggatgcctagcatgggatgaggatacatccataaataaaaaggcccaatcccttccctagagaagatgactttctcctcataggcatggaattgggcaaggtgatggggggtgtagagagtaaacctaaaaagaaaggaaatgttatggtgcagtagaaggtcagcattctacagggatgaaaacagagctcagtaagaggggctggaagtgccagggccaagggactgggaaagtgtagttttaaacaaattggtgtaggtaagctgcactgagaagttgatgtttgggcggagactggaaagcagtagggggttagtaatgtgactatctgaaggaagaacttcccaggcagagggcacagccagttcaaaggcctgcaacaacatgcctggcatcaaggaggagcagggaagaggctgttgtgggcccagtggagggggtggaagtggaagtagcagtgcatgaggtccaggaggtaagagctagaaggagggagacctcatgggccattgaagggcttagctttaattctaagtgaaatgaggaactcattggatcatttttgaacatagaagtgacaccctgtgacttaaatttctagaagatcattggccgctttgttgaagtagactgtagagaaacaagggcacaagcaagcagggagactagttaggagaggattacagttgctcacattagagacactgatggcttagactacagtggtgtcagtggaagtggcagaaagagtcagattctggatatgcttctaaggaaaagtcaatgggattttcctaatacattgagtaatggctaaaaatagaggcatcaaggatgacaccgaaatttttggtctgagcaactggtaggatatggctgccattaactaagatgagagagactatctgcagatttaggaggaaagatcaagagattggttatagacatgataagctgagatgtcatttagacatctaagtgactgtgtggataggtagtttgatacacaagattggagttcagtagggagctccaggataagtatatactttggaagccatcaacatatagatggtatttcaggtcataagactggatgagatccccaaggaagtcagtgaagatgggggtgagaagaggaccaagggctgagccctaggcactttaagaggtcagggagaggaagagggatctgcataaataactgaggtcagagaagtagaagagctgagagaagacaggaaagaaaagtatttccaggaggagggagttgtcagcaatgtcatatgttgttagtatgtcgaataagcaaaaaactgaaagtccatcatttgatgtagccaaatggaagtcactgatgacgagttgttttattaggctggggatggaggcacaaaaggctgcttagagcaagccttaaagagcagggaaggagaggagttggagacagtgtgtatagaacacactttagagtttctgtgtagagaggatcagaaaaatgagtggtagctaagggagagagtggagtcatgagggattttttgagctgagagatgacagcatgtttacaagctgctagtaatgaagaaaaagatgatggaggaaaggggtgtgagttgctggagggatgtctttgagtaggtgagagcagagtgacttggtgcactttggagaggggttcacctgagacagaagcaagggtggttccgccccagaaatggagatggagaagagccaagcatggactcaggcacggttgatgggcagttgtggcaggaattcctgctaagttttcttctgctcacatcactttttcaatttagggagtctcagttactttattatctctttctgtcttgtgatcatcatgatagagaattagtacacaaagactagagggattttggggtaaaaatctggtgttgataagggaaacataaggaaacatgacaagagcttgtaatagtcccattgggaacatttcccaatactgttggagtgtgactgactccgtccagacacaatgtactgaaagttgagttcttatttgtttcttatgagaatctgatgtcccatcaggaggtatttaatagggtactgtcaataaaaaagaaagaagagagaaagaaaaggtgagtggggggactaatgttcttgtccctttctcctctagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggtaagaacacaagctgagggtctgtgatgagctagagcccgggtagaaatgacacgcttgggggtagcacctcatttcaagacctaaagaagcaattggcaagaggtgacacacctgagctctacagttacacagaactggatctaaatctagagcctgccactgttagctgtaagactttgggcaagttattgaaccttcctgagtctccatttcctcatcgataaaatggctttgaagatttctgagaggatcagatgaaagtacgtgaggtacccagcattttgcttgccactcaataaacattcaagcagtagtagctgttctgtaacttagaattttagttcagtttagcacacacttttttttagcaacttgcaggcacagagccctttcttagcacactagagcaactaggaaaactagcccaggtcttcagtccctcggcctaaaaggagtccagttctcgtttattttcttcattgctatttatgaatagcggtaggtgagaaattcagaggatttgtgtgcttgtaagatgcacattgagccctctatctacccagtgctgcactgcctgtctatatagctggcaaagggaaggctgtgagtgtgtcagcctctccacagacctgagctcaaagagaaggaatggcccatccactctctggggccaggcaggtggcctcttgcaggctgagggctgctgtttctcagggactcagtgggaaaagtaaggattcccttttcagtctggctggaaaagtctgcagggggtggtttgaacatgcatacaaaattttatagagggactactgtgtactagcaactggtggatagcaggcgcagtggctcacacctgtaatcccagcactttgggaggctgaggtgggaggatcacttgagcacgggagttcaagaccagcttggccaactggtgaaaccttgtctctataaaaaattaaagtttaaaaaattacccaggtgtggtgtcgtgcacctgtagtcccagctactactgaggctgaggtgggaggattgctcgagcccaggactttgaggctacagtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatcttactttctgaaagtaacagaggagagagcctttgttctatcctctttgtaaagttgtactttgtgaatgcgttcccatgtaagattaagattgcagcagtaaacgacctgtgttattgccatattggtcagattacattttctccataatgaaattcatagacttactagggttatctagactcttttataaaagataacaacaagatcagggagagggtcctgccagacctgttgtcttgatagcttgcacaacaatgaagaaaacatttccctattgctaaaaactcatttaaaaataagcagtccacatttcaagtttaatagatgggtgtatttataaacagttccagaaactttcccttcaggcagcctttgctttttcacataagaagcaggcacgtaggttactgagctccaatctgaggcctggcaaggacgaaggctcccattcagtctctgcacgacgcagcagtgcagtaagcagcagggaaactctacctgtggcaccaagtaacgggccctgcagcccgtgtgctaaaaacgagctctctttgttttggtttatatttttaatgagctttcacaagaacattctatttgaattttatagaattcacccaaaaatcctctaagctgccgttccaatctcactgtataccaagataagggattctaatatagagggccaagttttcagagcctgttggaaactctgtcactaaaaatctatggacaatctgaagaccatctgaaagaaagcagtgattgaaggagtaggaaatgggaagatgctggaggctccagactcccaggttagcatccttgtcgagggaagggagagagctggctgcaggtgggcaagttgcccacccacatctcacttgagtcagagtgcccctgcctgtcatggaaaacaccctgacctcatttctagggaagttgtggtatcaacttgaagaggttttaaaaataaagaaacaggccgggcgcagtggctcacgcctgtaatcccagcactttgggaggccgaggtgggcgaattgcctgtgctcaggagttcaagaccagcctgggcaacatggtgaaaccctgtctctactaaaatacaaaaaattagccaggtgtgggggcatgcacctgtagtcccagctacttgggaggctgaggcaggtgaattgcttgaacctgggaggcagaggttgcagtgagccaagactgcaccactgcactccaacctggacaacagagcgagactccatctccaaaaacataaaaaatatttaaaaattaaacaactaaaaataaaaaagtatgggtgggagaggcagaataaaaataaatagtaattggaaatcagtaactgaccctatctgaaggaaagcatgtggtctttatcctgaggcccctctctaacccaaagtctcagtttgttgggagccaggcagactcccttcttcaaccaatttccaaacgactgagcaaaagatagatttgcttttgaagggcaataaaggagtacccttggatctgtctgcccttttctgaccagctaagatgtcactgagatgtagctctggcctacacatagcccttctatcaggcagtggcttcaggattcaagggttccaaccccacgacaggggaggacctgccactggcaggagcaagaggccgaggcggattcccactccctctctacgcccacggcaccgacctgaacaggcctgtcgtgggggacactgcttggccatagctgctactcctttcttttatacatggactccgtggagagatggggaattaagatgtttctagaccaaccttctgccgttaggtacacccttacagccattcagggctaaagggaatctgctgtttctttacctccagagaaggccctccatggaggaatattccacagcctccccagctccctcgcctactctttgcagcctgagctcacagaagaaagaggtgggtgagcttcagaattaggaaaacctgggttggaaacccagcccacaggtggatcatccaggggactgtgagcagttggcttagtctccaagcctcagtctcctccttttcctgcctgtgaggccgtggaagcagtaccaccatgttgcattcacctctgcctcctgtgcctggtccattccctgacccagacagcagctcagtcaccagttagcctgcactgatttgaagggagagaatacttttcttgcagttaccgtgagaattaaatgtgttgaatgcctggcatccatagggcctctcatttgtaatctttatcttccagaaattattccctcctttgccctaaaccctagtgttatcatcctaacgttccagagaagggaggagggctcaaaatttaagagcgtccctctcttcgtgggctgggcatgggattcttcgggaccttggcgtggctgttgtaccctcaccttcctgatcccctcagatcgctgagctgaggatctctgtcacaggactgtcctcctcttcagagcctgctggtgaaggagggatggctcccacccagtcctgtccccacagccttcccattaccgggctctgagcaccaggctggggaggtcagtggcttcccggagaaagctgtcttttcagactcctcctctcctgggccctcacttgcccctccaattcttggggcctacagccccaaatccccaccccagagagccagggtaagggcagtgcctgccagactccacgcacagccgcgttcccatggggcagcagcggctgagtggcaggccagcttctggccagcccaagcttcaggaggaaaccagatccaaagctgccctcctgggacatgcacaagggaacactcccctctcactaacctcatcagaatgtccctgtcacagagttcaagaccagcctggcctacatggtgaatccccatctctactaaaaatacaaaatcagccaggcgtggtggcatgtgcctgtaatctcagctgcttgggaggctgaggcagaagaatcgcttgaacccaggagtcagaggttgcagtgagccgagattgcaccactgcactccagcctgggtgacagagtgagactcgatctcaaaaaaaaaaaatgtccctgtctctggtgtttacataaccggagcaggggttgaagggtccaagacatttgtctgggtctagctctgctccaaagggaagcactcaactcagtaggattgggaaagattaaaaacaacccctccattcttgtcagaagtttgcatcccctttgcgacatgccattgagcatctggccgcccctggccaggcatctcctcctatcctggtgcctccgctgtcccggggaggctttagagagaacctcccacctgcaaacacctgcaacccaagaaggcgcccttcctcaggtggtagcagagtgcatccccgccacatggacccccgttagcaggaatatgggaggcttgggcaaggcagtcatattaaagccatttgtggggccgtcagaggatcactttgatttataaagtatgaaagtttgccatttatgaattcacagagaatgacttatttcccttattttcttccaaagaaacagattactttcccaattctagtgtgaaaaatgaattgcagggaaaatgggtcactttttcacaaatgttgaaagttctgcatttgaggtttcaatcaccccttccctcttgtgcgttgcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtagcgggttccgttccttgtaataatgccttcactccttccctttttttttttttttaaagaatgtgctaaagttttaaatgcattcagattgcctctagctttgtttggccttttagcttgcagtgagagtttgggtttgtaacaaagctcatatataatgtcttatgttttgaacagatcactacttgcctctggtgtgtgaaaatgtttcagaaacttcagaattttaagcctcccattgggaaaacaaggattggctcaaatgttatttcatgtgataaacacagaaatattaaaggtgttcaggatttctgctaaacatcagaaaccctacactgtgttgcctcatcatatttttttaaatgtagatacagttgtcataactttcttaaggatatggatacattctgacatggaagcggatttgggggtgaaacagccaacttttctctagcacgccacgtaaacagtgccatcttgtggcccagacaggtcatcgggcatggaggccaaagtgcttcccgcaaggacagtgttttagttttatctgtgtgtgtgtgcttgatgttattttggtcaggttggcagagacttgggaactaacaagggccatctgagtccccttttcttctcagcaggaggcaaggaaaacagggcaaagggcttcttcccgtaaaaggcatctgactataggccataggacaggtctgtgaaagtctctggaaggcctcaaaagaagacttgatcttgaaataggagaatccatgatccatagagcgggtgagggactgtgggtgggagggctggcaagagaacagccagagtcataaaaacaaattccacggacaatgaaaaggacactcccccaggcctcaaatcatctgggaggactgggggctgagctgcagaaactcaccccatgagtcactggcagactgctcactcttgacactggaatctctgtggttctgttgtttttatgttaaaataagacaactaacacctgctaaattgaacctcagtggtattttcagcctactgactcactgaatgttttttacacttgttcttttcttctcttagcaaaatctttttggtttgttggcatccctatgtgtgtgcgcacacagatatttttcttttcagattactggtaaagatgcagctgcaaaaacgacattgagcatttcttcctgaaactggacctgcaataacagatgagctagtttgttagtgtccagatctgtccatgaaagtcgctcagtttcgctcactaagatgtgtgcagacctgctagaggaattgtggctattgtgagcaaatgctgaaatagcccttcttaggaaaaccagacagattcacggctctcacatgatttactccctttattcccctcactggtttttcagttaacatcctgaatatcaaaattgcacatattctccatggcacaataattacatcctcagaatggcaaatgataaggtttagtatctccccctttgttatgactgaagttatatggagggaataaaatttattcctaaagctgaagtatttctttataatctttctaaaacttagcaacataactttaccctttaaaatcacagcaggcagattttaaccttcaaaattgggcctcagtgaaggcatcaatactgttttaaccaaaccttgacaaattaaattatagtgaaggatagtttcatatgaaactctaggctgtgttctgcacctgcgattcttaccctttgaagagtgtcatcacccctgtgggcaagtgttcctctttacctcattttctttttcattttattgtatcttatcttatttgagacaaggtctcactctgccactcaggctggagtgcagtggtgcaattgcagctcactgcagccttgacgtcctgggcttaggcgatcctcccacctcagccccctgagtagctgagactacaggtgtgcaccaccacacccagctaattttttaacttttcatagagacagggttttgccatgttgcccaggctggtctcgaactgctaggctcaagcaatcctcctgcgctggcctcccacagtgctgggattacaggcgtgagccaccaccccagttgtttacctcttttcttaaggctctttcttcaaattgcctgagagggagccaccatcacttgccactgggcatgtccaggaggggccacaggtgctcccgctgcctctgaaactactgccttggggtccatcatgtatgcgacaaggaggctaaccccatgctcttgttccctcaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtaaggggctgcggggcctcccacctgtctgtactccagcaggctgagatgcagggtctcccaggactgggcaacttcgccttctgcctgggaatgaccaggaaatgctcagagaaggtaaggcacttgctctgagttctacagtgcgtcccgccgggggctcacctgcacagccgcacatgcagcgcctgtgtttgctttgtgcatgaaatgtatcttgggcctcactgaagttcttaaaagaaatcctaatttgataggacctgctctaagcatagtggtgtctgcaagaggacagcagcatccagctgttggctttctgaagaacgtgatgggcaacgcttccgaagcactggctccctcactcccacacatgctgagccgcttcttttgtttgagaaacactagagcaacatgcaaatgtcacgtaaacttcagtgaggagcccactttgtcctttacttttttgagatcagcctgattcagagtaattattgtttgtagagcagccagatggtatagttagaggtgaagattgctctgcatatttcaaaatattacaaatgtttgaaaataagttgctttaaaaaatttatgaaaaggaagcttcagagctaaaagtttgcagggcaggattttcaaggatttttttgtttatttgtttgcaaaagaatttaaaactgtattgcttggcaatgtgccttccgcgcatctgaggaagtgtgtgcctcccagagatcaaagtgacccaaagcagtgcagagcaaagggtagaaaagatgagtttgaaaggactcgccctctctctgatcttcagttctctacagaactcctagattggcaactgcagctagctgaggctctgggaggaagtggtaaaatggtacaagttcaggttaagttgctggaaattatataggtaaaaacattcagtggtgtggggcactgtcatttgataatatgtggaaactgggaagctggtgacctgtggtaaacaagctgggtaagggagcaaccttcttgcttaactcagtaacccaaaggtgatggtgactcctttggggaaggtggtgtggcagtggaccctgccctcagaagccccagaccttgggctagggtgttcaagtcctttctttgtgacctcaggcaagttctcctctgaacctgagtttctcttttgtatattgggcctggtgataccattgttagaagtaacagtgggtagttatatggcagccaccatgctcatgtttggtaaacagaacctatcattatcatagtatggtagcaaatgaactgtaagagttgcctggtttccaagagtgcctcagcaaaaagaaatatttgagcaacggcagtaatattttcacttaatccaatggattaagtggctgtaaccagaggaagtgacaatgaggttatattgaggatctcaaggtcattgttttgcaattcgggacctgttgatgctattaattggagacttaagtaccactactctgctccaccccagcccttataggagcttctaggcaaagagagagagagagacccacccctgggctggctggtgtgtggctgtctccaccccaacccccgactcccttcctgcccgagggttccagtctcttcccagtcagagaaaccccagccaatgctccgttttcagtgtgtaagattgtacctgatgggaaaaatcagttgtgtgaggagtcacaaatcagccctgatgaggtcatctttctgggcgtgggtcctgttgaccgggtaagtcataatgctctgatctttggtgtagtcattgtgtcttgcatatccttatccatgtgagggaattcatttttggaaactgcagtgggctcatggggtctttctgcatatctggtaatttccagaagattattaattcttggggtaacataagcctcctctgtagatgctggctgcacctgccaacactggccagccccagtcccagcccagctcacaccctgagcagtgtgtccatgtcttgactctgcagagttcacagtgggcatctcaagcttggctcaaaccagcttcctttcctgtaagacttcaaggacttcctttgtttcatgtactctttgggttatctcaaaatgtctggtcctagaactaccaggtgtgtggcaagaagaacaaagagcggagtacagcaaactgaaatctcctcactttggaaagttatagattggccaccatttaattcttccccagaaatggtgtttgaaattgccacatacaatgcagtgcctaattgaagttagagccattatcacataataatttgaaatccaggccgggtacatggctcacacttgtaatcctagcactttgggaagccaaagcaagtggattgcttgagcccaggagttcgagatcagcttgggcaatgtggcaaaaccccatctctacaaaaataaaatgaaatacaaaaattagccaggcatggtggcacatccctgtgggcccagctactcaggaggctgaggtggatcacttgagcccaggaggtcaaggctgcagtgagctgagattacaccactgcactccagcctggtggacagagtgagaccttgtctcaaaataataatagtaataataatagttttaaacccatgccagtgaaatagatattctagttgctcagtttcttcaataaaaagacagaaacgttaaggacccagttaataaaaatatattaaaggaaaagtttagagttggcaaagcgttttcaaaggtgtcatcttatttgatcttcacaacccttcacaacttcataacccttcatagcttcacaactttggatgaggtaaagcgacttagccaggtcaaacctccagcaaggacaggagcctgggcctttccaccatgtcgcctacccctgtggggctccaggcctggaaacaatcaggatgtggggagactgaacaattgcaagttccagtgtaggaaaaacacatttcccccaaatgtttacgggttcggcgggccttcttgactctgcttcaccctcatggggacactatggagcattatgaggcccttgaaaattaaagcaagtctgcagctccatgcccagccgcactgccccaggtcagcagggaaaagtgtctgctggctgagagatgctgccgaggcctttggatgagctccatgacagttttccaagagcaacggcttttggaaaaactccgtttagcctgcagtattggcatcagccttgcccacatttaccagatctgttccccaacaccctcactttctactacactctggagcctgcactgagaaaggacgtgcagctccgcatcacagctgcattctgcgtttcctcccaaacctgatgccttctcatgaacaccaaagctaggatgtcaagaattgcttctctgacccccacttcttttgggatgcttcctggtttgtgatgcgctgctggattccccagagaccacctcctctctcttcatgggcactcttggctatgccatctggaatcccaacaaaacaggcctccgccaggtgaaatcagaaaagtcccctccgagggagtgactcaagagttgcacatcccaagagacagcccttaagagtcatccctccaataccaccatctgccattagcagactggtgtgtattatagtcagtgcggaatttaggaatgactggcaaagtgcttccttgttggtttgctcgtctgttctggtcaaaaaaaagaagcgctgagctggaatgtgcagtacactctatgggtctcgttactttctggaagggcgagctgtggcgtggtatcccattttatgcctgtccttctgatagtgtgacaaaaaattgccagaaacaaaattacaccacatggtaaaggcagcatcaaaacagacacatcaccaggaacttccatagcccagtgaccaagtagtttctgcccaaggcctaggagcaagtcacagaaagaggtaagggaaggcctggtggtttcctgctccacaatgaaggctttcctcctcctgcgccttccaaggcacaacaggcaatagctcctgtgtcctgcggggtgcagcactcactcagtcctggaaacccctcccagtcacgctcttctctcttcactggcttcatcagatcacagccatctccatgtggtcgcccaccccacgggcctgaggccagcagacaagtcttgggatcagtttccactcctgaaagccttcgagcagagtttaagtctatgacagtccataatttaccagttgtgggatttagctggatatacttcagaggagagccattccaggctctcagagaggctgcctctctcaaagcagggctgcagggaccatgaagtggctgctggtctcttagcctctctgttctccagcttgtgagcacagaggtagataaggcacctggtggctggtgaggtgttggtgtgtgtgacaggccagctttccccctcaaaggtctgctgctgagcccagggcaggtggttccacagctccctctctgactctcagaatctaacaccttgtcatgggactcaggctttccacttttggggggctgcccaaatagtcttatctgtcaaagccacagtaaccgaagccttcactgtggccagagaaaacggaagagcagaacagagggggcctcacctgatacctgcatgtgctggagcaggtggctgtcagcaccctgtgcgggtgaccgcagctggcccaggccccactctttgatttgatgctgttcactttgataatctgctgaggtgactggaagagaagacccagggttcctgcctgtccctcagtgtggccactatgacttctgatcttccaaatggagtggagcatcaacggcaaatgaggggtgctcccagctgagcgccaggcctgactgtctgtggtactaaaagagtgaccctcactcttgatagctggggtggcctgggcctgccgggagcagcttcctctgctcactcttggcatttctgtagaaggtttggcagcacgactctaggctgggaaacaggtctgttgcctcaggtcattctgaatctgtcaatgcataaacttaaatgtctctgtcaaaacctagaggaaaggagtccatgaagagcattccctttacaattgacgtgatatgcactaaaatttctaccaggggccagagcattttcatcactcctagcagttttgaattgaaaacagagaattctgtcaagaattgtaaagaaattttcccttctttctgagatagggagccctccactccatcacgaaaaaaaaatcagaatggtaagacttttctagctctcactgttggcctctcaaagcaggagtagcaaaggggccgtatccacaggactgcctgaggggctcctttcatctgtagctgcctcaggctcagtgcaggagatggatgccctgtgctacagctgtgggagcagagctccaaggggttttggtcgctattctaagtgaggagtaagtggccaaacctcaattccagtgagagagaaaggttttccaagattggcaaagaggaagagcctgttttataaatgggataagcgagtatcttggtggttaagagctatgctgtgactcaaactctctgtacacttaacagctgtgtgaccttgggaaaaaactccttaacctctgtgcctcagtgtccgtatttggataaaaacaatgtatgactcctaggaatatgaggatcaaatgatctcatacaaataaagctcttagcacagtccccagacctagtaagcattcaagatagattacctataatccaaataataattactatatcaataattactcttaagtattaatactactaaattatgactgttatcattattatcaaaagtggagagttagaaaggggctaaccccttccagtttttcatcctcatgaatcagtgcaaatgtattgggctgaacagtctttctctgctcctgaggaactgttagctcctctctctcaactttgttgcctgacttctgaggaaagatgtatggatgacactctgaatagcctgacaggtttgttaaattctgaactaaacttcacagatcctgactgtgtggaccaaactccgtctgaacattgtattttgatgacgataataaatgtctactgcccttggtgtacttagataactggtaaacaaatgggtagtaaagacctttataatgagggtggggactcattttcaatccagataaaactgtgttccagatggagcctttcattttccgaggattttaagcctctgtccttactgagggcttttgttattccaggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtaagtcggtggaaaacccatcaggccaacccagacgttactgatttgcatgcttataccaagggttccctaagatagtgtaacctttcacatggcagacagtggctatctttcttacctctctatgcttatttacacagagtagaattttactactaataataaaaccatagaatcaggaaaccagttactagtttcagtctatatgtcgtagaatctttttacagtacacttgatagactgtaacgaaaagtaaccagtttagaggttgagggcagaatggagaatacagcagagaaaagaattaagactttttcctatgataaatgtggaaggagagagaggctgtgggaagataactctaagaagcagtagagaatgagacagagtgtggatgtgcacatgggtctttgggtgtgggtggccttctcacccacagaggacatcctgcccctcgcagccaggctgggcagaaacaaagggtctgcaaccagaagccctttcacaaggcagacagctgggaagtgcgtggcgcatggcagtacctgcacttggatggggcgtgccggggcctctccccgtgcagccgcatgcacacacgagtaatgggtgcctgtgaaaggaagcacctcctcccaggcttattttctgtgttcttggcagagcacattcaagtgactttccataaacctgtggctggaactgttaccattttacctaaaattggtgtcatcattttggtaatgaagcaggttgtctagctagtatcacaaacgacagaagcgccctcccgtttgtcagacatgtgagcacactgtgtctgcatccgcatctggccataaagcccatgggatgtgtttctagggaggcatcctgctcctcagcaggcctgacaagaggcagccagatcggggcataaaaacaaacagcgtctgaaaggaagggagtggagatgaatgagtgcccacacttcaggcagccatccggagagcatccttaagagaccacacagacgccagcatgtgttcctcttcgctttcccctcctcgcccgcctcatttccctctccttctgtgaatgacatgttcactcacagggaaactgtcaataagatgtgctataacctataagtgagaaaagttacactctcccttatgatagggactccagtgaggtaaagtgaagtcatacttcataaattcttttggttttgaaaatgccattgtccctcaccgtgtttcccagggctgaagaatgctcccttatgtaagaggatcttagagcagagcttcacatggccgttttggtttccatcactcttgtaaaacttttattaccgaactgaaggttttaaaaccactaactcttagtctaatgactatgcgtcgtttgtaaacatttacaagccctcagaaagcacacatgctgtaccatctttggtgctggagagtctatgtaaaggcctatgtggctgctgctgggtgccctcatttggtgctggcaccagggagagcatgtcataaaccaggggccccaagcgtgctcataaatgtatatggattcgtgtttaacagccggattaagtcgcttagcatttaagtagtgtatctaggcaaagggtgtgcctttgtatatatctgtgtgttttttattttttgactagccttagcacagatacagaagtattaaggaagttaactaacaatctagacttttttttttagacacagggttttgctgtcacccaggctgacattcagtgacacaatcatagctcactgcagcctccaactcctgggctcaagtgatcctcccacctcagcctctggagtagctaggactacaggcatgcaccactatttattttttgtagagatgggggtctcactttgtttcccaggctggtctctaactctgactcaagcaatcctcccaccttgatttgacctcccaaagttctaggattacatgcatgagccaccacaccagacctatctagacttttttaacacatcaattaaaatgatgtctaggctattgttcatgaccagctactttcggtgtttttgcttcctctaattgctagtctatgcttggactgtgtaacacattcatattttagtttgttactaatgcaagatcaccaaggttaagagcattgtaatgtttaatgattatctatacgcttgcttccaaagatgtgacatcattttggatctgtaacattttatggatggctctgaacagatgacatcattgcagcatgaaactgttttccagaaaacaagtagtaaaactcccttacttctcttaccacaggtattttacatggagctggactttctcagcttcccaaacagcgccatcagccaagtgatctacatgctgaccaggctccaaacagccatgtcaaatatgtctggtaaaattattgagatacgtgctcaactttacatccatattgtatgttaatagctcctggcttgctctcaagctaatgggccatgcttccagggagcccaggagtagccattgttggcactggcatctcaggcagcacaagagcactgtagagggacaggaagaggctgctgttgccaggtttggggctggctgcacaactcctctgttccgtacctaaccactcaaggaaggtcatacattggcagagaaacccagtcttgctagagggcctgagattccctgtggaaccagcactctaattagaggtgctatttctaatggggagaaaaggagctaataagcaaaaccaagggaaatctttgttcccaggaggaagcaggttctgttaatcagaatcagtctgagaactgacaattacatttcaagctaaaatgggtaactggattggtgagggccctttgcccttgtggaggttgccccattggtaaataatgagcactgataagtgaccatcttttcacagctggcccctggcctcacttttctccttttaaacaggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtacgtttcagaaaacagggcaaccaagactagctggccagggaggttgaggagcaggctggtcactggtacctaggcatttctgagctgcagcctctggagtggctgctggagaccaaggagagctgctacccagaggaggaagtgtagaggccggagggccgctgcgaaagggcactgggaagcccccatccagatatgcacataagccctgtataggagaacccagcaggcggccagcaggactcaaggtctaaagctaagtaaccaagccaattgaacaaggctgatctggcttggccgtcatggggctggggtgctcgatggacaggaaaatggagttacaaaacgagtgggttggttcaggaagggccaggattggggcagcaattccacgcaactgctccacaaaggaggtcccctggtctgaaagcctaaagtcaggtccttggctgcctgaggcctgcaactggctgcagggtgctggaggtctgtgggtgctggaaaggaccaatgcagaagcaaggggcatcatgaaacaagactctccactccctcccctacccccaaacctggagacttcaagggtcaacattttgtgaagtggtctctctctcaaatccactgctttgtattctgtggctgtgttctctttcccacaggatagtttcccaccccctgagtaccacagaatcccccctggggatgatacttaaggctcttggggcagctccatggctggctcctggcctgcataaattaatgtggaacagatgcgcaggcaaggcatactgggtgtcaagagtcaagggggagccccaaccagacagaccccagcttcctgtagcccagcccagggtaaaaacaggtgcacccactggaaaattgctctctgcccctccttcctggatgatggcctgatccatgagatcctaattatttacctaaataatagacatctttttccacacagcaagatagtggtggatcagtggcaaactggagtctgctggccctaacctggggactgagtggccccagcaaaggacagcaaacctacctccaataggttctgcctgatccctcctttcattattctcttcctgggatgggggcgtgtatctccttcacgccactgtttgggtaaaattatctgagaagatggaaagcagccaaccacaacaactcttaagatttctctagtttcttggatcatgatcatagtcaggctttaagctagggtttggcaccaggactacattgctgcttcaagttgatgactttctgagaataaacagaggtcagatgtccaggctgactttattagatctgccagaatcttctgatcagttgagtaaagcagcggtgatttggctataggatttggcaagggataatatcattacgattaaatctttagtccttaatgagaaacctccaaggccctgtgaccatcatgattccttagctgcttgggaaatatttcagatcttaaactattaagactgcagatttcttttgctgttgaactgtcttcaactgtgatccttctcttgtatttttgtttgaggcaggtactgtggagaatcatcatagctggaaggaaacagacctcagtttccctaggggttgagatagtatctggagtcaccactcctaaaagttgctgagattattgggattgtggaatcagagaagcaacactgaagctctagataccattttcagcactgattttccactgctgtccagggctgaaagagggttgggattaaggaatgcctaaaacagaagtgggaagacatgactgagagcaggagcactgtgcctgcacagccaaggcccggcactggctggaaggtagatgggccagtgtgccttcagcctccacattctgctttctctattccactttctctctcctgaagtcattaataggaataactgctgccttaatcctatgtctataaccccaacctctcctactcacccccaagaaaactcaagctgcagagcgtctttgagactaaaccctcccaagtgctgtaatctagagtattttcaacatgagtgggcaggggagggtggccagcagcactgccttgtcagtgagctttcttgagctgtctggctcttagtgcatcccaacataatccacagacatgaggaagcctgtctgccgtgaacacttccagtgaagactaaaagtagtattttaagatctataaatgacttttctggtttttagcttttgcctagttcctttgaattttggaaggaattaatttgtagatgacatcatgcagtacatttaaatatggcaggattgagatttattttttaagtcagcatttgcttttcttggttaaatgcaaccagtttaggggtaataactgcttaatatgcctggcacattattgaaatcccttatgagtggctcaaaatgagtcagaaggtcaatttagtccttggctgggttcctttcacaacaggggttttcctgtgctgctgttcaggaggagcaattaaaactttttgtgtattcaaagctttccagctgaattctggccccatcaaatgatatcagagctctggcttttgcctggtggtgcagagctttcgtctgttagtgaatctttggggaccgtttttccccaagcttaaaaacacaagattcaaactctaagggattccttacttattcttctagcaagcctctttactatctctctgccatcgcacggactttctccagcttttaagacactttgatagcattgttactggaccacacgcagaactagaaacaagtctttctttaccacttcttccagagtagtcttgccaatgttcagtaggcaaaaaccacggaaagtttggtggctacctgagattcacaaatcagtggcttacaattgcaaacttcccactccacttgatctacacactagatagctaaaggacttcagggtaggaagaatttatagcttcagctgcctttgatgagcgctttctcagaaaatctcactgaagaacctagtgtatctcagttctatttgtgttccactgaagatgagccagacttttatgaacaataaatgtactttacatcctctttttttccataaaaatttccccttccgctgcccagcttctctattttctctggctttaaatcctaggatttagaaaagcagaaaatgttacagttcaaaaggttttttaatgctccgtccaaagccactggtttgaaagaggtgttctccactttaagacgttctatctgaagaggtttggggagctaggcaaacagagcttttatttcagtgctgagtttaatgttgaatagatgatttatgtggaggaaagatttttctccttttttcttgggctggctgctaaagaacaatgacagatgttttaatggtgagtagaatgttatcaaatcgtcaacttcaaacatgggaattttatgcaacaccaaatgcttattctaaggaggctgtcctaagtctcatgcacaactttcagttatactgctaaaactgcattgttatcgttgccatatctcagaggaaaaaaggaaacattctggattaatggctttaatagatgacctaaaaggcataatgtacaaatatatcgaggcaaaagaactaattttgttctggaactctcgtaagggtctggcaactaatctttattatttttggatcctaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 1399 - DNA, 864315 bp, Homo sapiens; identical to SEQ ID NO: 1398

SEQ ID NO: 1400 - DNA, 108494 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaa

SEQ ID NO: 1401 - DNA, 239644 bp, Homo sapiens
gggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtttcttcttacctacagaattctgagtaattgaactgattttcccaaggtcacagaacaggtccttcctagagatgtgaaagaattcagactttctacttgagcttagtactgagcttgtcctgggctatgctgccacttagccaaggaggtgaaggggatgagaggaggaagccataggaagggcatgtagcaaactcctcatagtatgactgttgcatgatttttaccatttctgcaagtttcatgtaatgtctctcatcagaatatcagatccagtgtctctcttcagaatatcaggaaactgtagggaaacatgtattgcttccttgtctaataacttctcatgtgcatgctagagctgacatttttggaagtgtgtcttgtggataagaatgaacagttattgagtgcttaccagggtcaggtgctgtgtgtatgtttcatcatctcatttaagggttaggacaaccttaaaaggttagtaaagtttttattcccattttgcagttaggttaatggagtcttgagacagtttgaccaagattacacaggtaagttagtggtagctccaaagctccagctttggaatctaattgatcagattccagagcttccattctaaacaatgtactaagatgcgtgtagatataatttacttggagggcgtcccagtattgtgaaacagtaggtaccataaaggttaatagtaggtgtttttttttttttttccaccaccaagatgagccctcaattctgtcttcaaagcaaattctgtcttcaaagcaaagaaattttggtctaatacttgagaaatagtccaactttccatagttgtaaacttactaaaatctaagtaaaatgatatcatgttatcatgatatatatcatgatatatataaacttgttcttattttaaaaataatacaaacatattaacagataatttggataatggataaaaagtaaaaaaaaaaaaaaaaaatctgccgggcgcagtggctcacgtctgtaatcccagcactttgggaggcggaggcaggcggatcaccaggtcaagagatcgagaccatcctggccaacatggtgaaacccggtctctaccaaaaatacaaaaattagctgggcgtggcagcgcatgcctgtagtcccagctactcgggaggctgagggaggagaatcgcttgaacctgggaggcagaggttgcagtgagctgatatcgtgccactgcactccagcctggtgacagagcaagactctgtctcaaaaaaaccccaaaaaaccaaaaaacaaaaatcaccacccactgcagtaaatattgctaacattttgggtgtatccttacaggtatttccttttagtttcgtattttccatacttttagttttaatacaaatacaacttatttagtcggaagaattatcctacaattcactggagtttttataaccttcttgagaatttagaagaactgttccatggagtagagatgctacaagtcttttacaagttaaattcttgaccccggaatcagattgtcctaagtttgatcttgccttggctgtctataactttggagttactacttatcctctgtaagcctcagtttctttatatgtaaggggttaataataatacctacttcagaaggttgttgtgagggctacataaaacaatgtctataatatacttaacactgtttgacaactgagaatcaagcattcagtcaataagtggaacctttaaataattaccattatgtttttgttgttaaaattttgcaattttgtaaataatgcagatacaagcatttcatgcatatgggttttatgtatctgagattatttctttaggatagagtcctgaatactttaatggattttaagtgcatagttcaaatttatacccatttataccccataatatgtataatagtgtgagtattggatattaatgctaaaattaggtgtgttcatgtacactcttggatattttgtgctaactgtactttgttttaatttttgtttcatttctgttgaggaatattttcccatgtttttgttaaattgatttatttttacttaagaattgaatattagatgtatttacatatttttaaaagtatactcagtatttttcctatcaatactatctacgattattgcatagctgctcttttccaggtgttgtgttagacatcagtttataatcctcacagtaaccttgtgaactagacaatattatgctcattttaaagatgagaaaattgaggctcagaaatgttagtacttacccaagtctggtaagtagcagagccagagtttgaatcctgatgtgtcttactccaaagcctcccacactacttatatactaagattttgtctgttaaaaaatattgaagaacatactaactttctgcttttcacatgtcctgcaaatacttttcactcttttattttggttgttttgacatataaaaggtactgcttaaaaggaggtagtcagattagactctgagttggtgacacttatgctgctttatgctggcatgtttgctccctttattacactgtgttgttctctgagaacagttcatcctggcttctccatgcccctgattcttgggcattgtatggatgtgagtttgtttattcagtcattctctgcatttttattttctcctggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctgaaaaccctgagggagaactgtccaagtgtattattgtttttctctggcattaggattttcccattcaaaggcaaaaaggtattgggattctggggccagaggaatggaaaatgaagcatcttctaggtctaggactgagaaccatttagcatcccttggcacctgagccaggagggtatatggatctgccaccaatgggtggacctaccagtgggtcttaagagcccaggggtaagtaataccttagctgtggatgcttggcctttccttgcttccagcttaattgggtattgtttttgattgggaaaataaatagctaggggtctttaagctgtattttggctggcactgctgttttagccttccttggttttccagtataccatgccagtgtgttaacctgtttattaatgtggtctgggacagtgtctgtatttttgactattagcaatttcaccagatgatgcttaaattgtagtagtgcccctattttaaccataatatctctttttaacagggggcctgggcagcttgatactactagaaattactgttggaagatttgtttctcaatttgacaaatcaaaggaggaataaaggatcttacttgtggctttccttccattcccataatggtcgtggactgggaggaaagttttcctacataagtagtaaggaaagaaactgaatttgtattgaaaagaaactgaatttgggtgcccatgacgtccagagttacctgggggctcctcagtagtaattacgatgttcctgaacaggggcagtgaggaagaccctgggtcgcttcagtcttcatctaatttctcttttgcactgctagagttttgccttattgaaccccttggtgggagcagggccagtcaatcttccagtgccaggggttgtaactgatgctctcgcatttttggcaggggactggcaggggcttaatatagtcctttatccaattctcgtttttcttgcatttgaagcaagagtctttgttgtgcagattatcagaggcaagccaaatcaaccaaattccaagtggctggtgtgctccatcaattcctgcaggcctgaaataggtagcctaggaattccaaataaatagaacacatgatgacttgttggaaattcgcaggaaacaaaataactattctcagaaccaaataaaagccttccactagaaactaaaaaatgtctatggttttatatatatgcatacacaagtaaaacccaaaggagaacaaatagcaaacaaatgaaaattagaagcaaaaacaaatagacaggaaaccatctctaaatttttcctacttagtctacccggggggctacagtgttacccagagccccccagaaaaccacataatgaatattttattcctgatacacaactcaatatccttaattccaccagtatcaccatacatactgtgcaatgaagaaattcactctaggcacatgaccagtaagtactccagtgccagcttgtttagtaaagttatacttaagtcatgtgaacttgaaaattgcttagacttatttacttaatttatgagcgctcctttaattataagccaatctgatagacacaacatataacagtaagtgtacatacaaataaacacatctagacatgtatacacaaacacaaatgaagatccaatagctttttaccttggaactctagccatgagatagcaatataagtccactggttttactgtttgacccaatgggtaatccagtgaaggctgtgaaccaaaatttcaggtcaagcagtttccatggtagtttgatttttaaaggccaaacctccccagactccaaacactggggccaaacagcaccaaaggagaacaccacatgctaaccaggccaaccctacttagaacagcagcacaaaagcctggatacatgcacctccatcccaccttcccattcaacagcaaactccagaattccaagcaatactgggccaaacagtattgcaaaagaatatcaagtttactgaatccttatttcccattactatatcaaacacacacaaacaatgactgcagcacagtccaactgctgcagcaacaaacaagccccaagagtgtccagactgtcccattgtcacctgtgagagaaaattccaaggaggcctttgtgctagacctcagaacctctgccgagggcgtcccctttggagaggttcaggtctggagttggattccccggggtgttcccctttgggatccaatcttagagtgtcagacgtctctgaccttagttaggcatgggtgctgctttgtatgttttccctccagaggtgatggcgtactatgaaatttgttttgtccctggatgaaagcctcaacttctagcatacttatgatttgataagaccatgctttcccttgcttcccgttccactagagtgttagccatgaactttaatgataggaaccggaggtgggtgcatttcttttgtccttagcaagtcagatagaataggagaaaggtcaaaactcctaagagacatcattgtttgccattactggttaacctataggataatttggcataagaaccctgtaggagaatttaacataagaaaacaaagtttaagtcacctgaaacgtgtgaattcaccctggatgagctgccatggccaactgcaacacacgtaaggatcatggactatagctggaaaagatagaaaagagtcctctccttccccctcctggtatgggcagctatcccccttggccttcaggtaacactggaaagtggccctggccagttgcccacaattatcagggagctactaggaaatggccactgaaagactgaaaaagaaaaaaaggaaaggactcaggcctctcacccaaactgggcggtggtggtcaggtgcttccacatagaaaactcttggtttcactggagtgtggccccggccagaaacctgcagttgcctctgtgcttaggcattgtgcgctgaagggcccaagttggaaagggaaaagagaaaaaagcattcccctgtatggagcagagaggaaaacgagaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccgcaaccaatcagaagctgaagttacaaatttacaccctatgcaaatgtctaattggtcatagaaagcaaccattcagaggctgaagtgaagttacaaagttatactcctatgcaaatgaagacttggcccatgactagcctgattggttgtgggaggggatcaatcaaaggtacttcgaattttttcatctgccacgcagaaaaggggcaggagggttgcaaagggagtggcttctggtccttttgttacttgggcatgggaagttggggttggggttttccttttgatttagttctaggaagtcagcatgagttggccttaggttccctgcctccagaccctattctgcctcaaaggaaagaaatggcaagctctggaatagaatatagtagtgctagattttttttttttttttaattaaatacagggtctcactctcttgtctaggctggagtgcagtggctcaatcatggctcactgcagtctctacttcccaggctcaggtgatcctcatactcagcctccagggtagctgggactacaggcatgcaccaccatgcctggctaattttttgtagtttttgtagagacagggtttcaccatgttgcccaggctggttttgaactcctgggctcaagcagtcctcttgctttggcctcccgaagtgctgggataaaaggcatgagccaccacgcctggctagtgatgctagatttaagctatattttggaagtaggatttgataggttggatgtgaaggatgaaaaaaaggaagacattgtgaagatacctcactggtttgtggcacgggaacctgggtggagggtagtgccgtttgctaagatggaaaagattagttttgggagccgacacaagaattcagtttgtgcttgttgaaaagctcaagaaactcaagtggagaactgatgactgttggatataaaagtcaggagttcagaggagaggcctggctgggttggagataaccatttgggagtcaccaacatataaagggggttttaaaaccacttagagattgagtagaggaactagcttaaaggaagggaagcaccattgtttcttgacagaagttaccaggtgccctgagatggggcaacccagggactctagacccagtctcttcaactttacagttttgttcctgtcacttttgttgtctttagttgacccttcctcatcctctgccaataccatttacttcctttcttatcatggatatgtgatacacactggtaccttacaaaggcaattgcctttatggatctttcatttcattttttttaagagaaggggtcttgctatgttgcccaggctgaagtgcagtggctattcacagccacaatcatcatgtagtacaaccctgaactctcctgggctcaagtgatcctcctgcctcagcctcttgagtagttgggactatcgtcacgtactactgtgcctggcccatttacattttaatacaaaatgttctgtccctgacatttgggttctccctcagtcttattttatgaagtagatgctggctaactcttagtagagtttagaataagatagaggtacatacctggtcaatagaaagggattcctggagaatagggtatctggatggagggtagaggttttgttggggaaaacaggtagtttcttagtatcctgttatttcatgatgtgaattagtgccagattgtttcattgacatcattcatcatacttcaccaggcatatactgattgtcacttgtgtgttacgcactgcgataaatgctggggtttctttttttttttttgagacagagtctcgctctgtcacccaggctggagtgcagtggcgcgatcttggcccactgcaggctctgcctcccagattctcaccattctcctgcctcagcctcccaagtagctggaactacaggcgcctgccaccacgcctggctaattttttgtatttttagtagagacggagttttaccgtgttagcaaggatggtctcaatctcctgacctcatgatccacccccctcggcctcccaatgctggagtttctaaggaatatgaggatgtgctgtaacacacaggtctatatcaataactaggcagtacagaggaaagccagtgccgaacgtattggcacaaccttcactttctgcaagtagtccctaattttctgtatcatagctgtatatttttatgtgtttgggtctaagctataaatccactcactgaccgtgtgctctgctcttggccttatttatttctggagattgctgacatttgcccttttcctcagatgctctatccctgtgggaggcttctctttccctttaacactgctgcatactgcatagttattaaagacctaccccatcagactgttgatgcaataacacctctcatttgcccccctcctgcagtttgtctttgaatgtgacattggtaggtcttttttcttagacatttctttctctttaagttgttggttaatatttttcttttagtttccttaaacgtttattgaaatagtgtttgcatgtgttcattcattcattcaacaaatatttatttagcacctattacatgtcaggccctgttgtgagcactgaagacacagctctgatcaaaagcatttaaggataccagtcctcttggagcttatgttccattatggtctttacattctgcctatatgtcacctcattttttcagcagtgctgatgacctgcatattcatgattctttacttagtacaatttcaattaaacaactcaatgccagccacagagccctgttttaacaataggcaaccattaacttgcatccttgatatagaagaaagtgtgctgctgtattttgttgttgtttgttttgctatacctttttatcttgaaaaagaattaccagtctggttttaaaatgtagcagtcatttattagtactgtgtgattgcataattaggtaactgtgcttaataaatttttagtgatgtatatagattattttttaacagtcttaccagcagtacagctttggttagcacatgctataagtaggtttatcttactatggcagacataagcatagtctatgaatagtctttgatgtaacctctaggagaataaataactctaaggaaaatatatattaaaaaaaattacctgtgaataacttgtgatttcttcttgccttgtccacaaatcatgctgtaactttaaaaaagaaatgaaaagtaaatgctgctccattaaaatttgtaatttaaaacttagaaaagtatctggtagaatagcaattaatccaaaaccctaaaattttgaatctgtttgaaaaactattcaggagtgaaagtttaggtattcacatggaaataattacctttaaatacccttactggtaaattattttatacaagacgaatagattctttgtggttatcagacaataattgaaatgtttactttgtatgatttttattattaaagtctttgcttcctccctactaataacttgctgagcatcagtgcaataagatatcatgtcattcagtattaatctgaatgttcagcagacttgaaataaatagcaacttagatatttagacattttgttgggaataggcccccaaatctggccataaactggccccaaaactggccataaagagaatctctgcagcactgtgacatgttcttgatgaccatgacacccacgctgcaaagttgtgggtttacggggatgagggcaaggaacacctggcccacccagggcggaaaaccgcttaaaggcattcttaaaccacaaacaatagcatgagcgatctgtgccttaaggacatgctcctgctgcagatagctagcccagcccatccctttgtttcctgtaaggaatacttttagttaatctataatctatagaaacaatgcttatcactggcttgctgtcaataaatatgtgggtaaatctctgttcgaggctctcagctctgaaggctgtgagacccctgatttcccactccacaactctatatttctgtgtgtgtgtgtctttaattcctctaacaccgctgggttagtgtctccccaaccaagctggtgtcagtacatttttattctggctaggttcttagctatggaaatcctcatagacaagtcaagatcttactttatgaaatgtatgcaataggagagtcagtgggatgtcactgtgattgggaaaaatgtttacccaagactattatcttctgaagctgggcaccaatatatacttgaagaatatttataaaatcgagaaggatttaaggaaagtacaggcctacctcggacatattgtgggtttggctccagaccactacaataaaatgaatgttgcaatatagtgaatattacaataaagtgagtcacacaaatgtattggtttcccagtgcatattaacatgtttacattgtactgtagtctagtaagtgtgcaatagcattatatctaaaagatcaatgtacatactttaattaagaaatactttatcgataaaaattgccaacaatcatctgaaactttggcaagtcataatctttttgctggtggagggtcttgccttgatgttgatagctactgactgatcagggtagtggttgctgaaggttgtggtggctgtggcaacttcattaaaaaaaaaaaagacaacaatgaagtttgctgcattgatagaatcttcctttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccacttttttttttgaattcatagaaagtaatagattccatctcaaggctccactttctttgagttcttcaggttgcatacgtaaagagcaactcctcatccattgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtttgagaccagcctgggcagcatgtgagacctgggctctactaaaaatacaaaaaaattagcaggcatgctagcgcatgcctgtaatccctggggtggctgtggtgtgagaattggttgatcctgggaggtggaggttgcaaaaaaaataaaatgaacgaatgaatgaatgaataaatgaagtcatccatgagggttgaaatcaatttatttcaaactcctataaatgttgacttcttttttactgttttttgagacagagtctcactctgtcacgcaggctggagtgcagtggcataatcttggctggctgcaacctctacctcctgggttcaagtgattcttgtgccttagcctcctgagtagctgggattacaggtgtgcaccaccatactgggctaattttttgtatttttggtagaggatggggtttcgccatgttagccaggctggtctcgaactcctggcctcaagtgatccgcaccccccttggcctcacaaagtgctgggatttcaagtgtgagccatcacgcctggccaatgttgacattttgaaatttcatgaaccatgaacattctaaatggcatctagaatagtccttcccagaagattttcaatttactttgcccagatccatcagagtaatcatttatggcagatatagctttacaaaatgtatttcttaaataataagacttgaaagtagaaattattccttgatctgtgaggcacagaattgatgtattagcaggcatgaaaacaatgttaatcttttttttcctattttttttttcattatactttaagttctagggtacatgtacacaacgtgcaggtttgatacataggtatgtgccatgttgttttgctgcacccatcgactcatcatttacattaggtatttcttctaatgctatccctcccccagcttcccaatccccgacaggccctggtgtgtgatgttccccgccctgtgtccaagtgatctcattgttcatttcccacttatgagtgagaacatgtggtgtttggttttctgtccttgtgatagtttgctgagaatgatggtttccagcttcatccatgtccctgcaaaggacatgaactcatcattttgtatggctgcatagtattccatggtgtatatgtgccacattttcttaatctagtctatcattgatagacatttgggttggttccaagtctttgctattgtgaatagtgccacaataaacatacatgtgcatgtgtctttatagtagcatgatttataatcctttggatatatacccagtaatgggattgttgggtcaaatggtaattctagttctagatccttgaggaatctccacactgttttccacaatggttgaaccaatttacactcccaccaagagtgtaaaagtgttcctatttctccacatcctctccagcatctgttgtttcttgactttttaatgattgccattctaaatggtgtgagatggtatctcattgtgattttgatttgcatttctctgatgaccggtgatgataagcattttctcatgtgtctgttggctgcatagatgtcttgttttgagcagtatctgttcatattctttgcccactttttgatgggtttgtttgtctttttcttgtaaatttgtttgagttctttgtagattctggatattagccctttgtcagatgggtagattgcgaaaattttctcccattctgtaggttgcccgttcactctgatgatagtttattttgccgtgcagaagctctttagtttaattagatcccctttgtctattttgtcttttgttgccattgcttttgatgttttagtcatgaagtccttgcctatacctatgtcctgaatggtattgcctaggttttcttctagggattttatggttttaggtctaacatttaagtctttaatccatcttgagttaatttttgtataaggtgtaaggaagggatccagtttcagctttctacatatggctagccagttttcccagcaccatttattaaatagggaatcctttccccatttcttatttttgtcaggtttattaaagatcagatggttgtagatttgtggcattatttttgaggcctctgttctgttccattgatctatatctctgttttggtaccagtaccatgctgttttggttactgtagccttgtagtatagtttgaagtcaggtagtgtgatacctttagctttgttctttttgtttaggattatcttggctatgtgtgctcttttttggttccatatgaactttaaagtagttttttccaattctgtgaagaaagtcattggtagcttgatggggatggcactgaatctataagttactttggacagtatggccattttcacaaacagattcttcttatccatgagcatggaatattcttccatttgtttgtgtcctcttttattttgttgagcagtggtttgtagttctccttgaagaggtccttcacattccttgtaaattggattcctaggtattttattttgtttgtagcaattgtgaatgggagttcactcatgatttggctctctgttaatggtgtataggaatgcttgtgatttttgcacattgattttgtatcttgaaactttgcagaatttgcttatcagcttaaggagattttgggctgagacgatggggttttctaaatatacaataatctcatctgcaaacagggacaattttacttcctcttttcctaattgaaaaccctttatttgtttctcttgcctgattgcggctagaacttccaacactatgttgaataggagtggtgagagagggcatccttgtctcgtgccagttttcaaagggaatgcttccagtttttgccaatttagtatgatatcggctgtgggtttgtcataaatagctcttattattttgagatatgttccatcaatacctagtttattgagagtttttagcatgaagggctgttgaattttgtcgaaggccttttctgcatctattgagataatcatgtggtttttgtcattggttctgtttatgtgatggattacgtttattgatttgcatatgttgaaccagccttgcatcccagggatgaagttgacttgatcgtggtggataagattttttatgtgctgctggatttggtttgccagtattttactgagaatttttgcattgatgttcatcagggatattagtctaaaattctcttcttttgttgtgtctgtcaggctttggtatcaggatgatgttagcctcataaaatgagttagggaggattccttctttttctattgattggaatagttccagaaggtgtcgggggaacccacccccaatattttaacgtaggttctttctgttttccataagtgtcatctggctgagaaataaagagaaagagtacaaagtgaggaattttacagctgggccgccgggggtgacatcccatattggtaggaccatgatgcccacctgaggctcaaaccaacaagttttttattaagggtttcaaaattggagggggtttaaaacagggagtaggtacaaagatcacatgcttcaaagggcaaaaagcagagcaaagatcacatgcttctgacctaacaggacaaaaggcaaaacagaactactgataagggtctatcttcagctttgcacatattgtcttgataaacatcttaaacaacagaaaacagggtttgagagcagagaaccagtctgaccacaaatttaccagcttggagtttttccccaccctaataagcctgagggtactgcaggagaccagggcgtatctcagtccttatctcaaccacataagacagacgctcccagagcggatgtttataggccttccccccctcccccccggcccccccaggaatgcattcctttccctgggtattaatattaatattccttgctaggaaaagaatttagcaatatctctcctacttgcatgtccgtttataggctctctgcaagaagaaaaatatggctctttttgcctgaccccacaggcagtcagaccttatggttgtcttcccttgttccctaaaaattgctgttattctgttgtttttcaaggtgcactgatttcatattgttcaaacacacatgttttacaatcaatttgtacagttaacacaattatcacagtggtcctgaggtgatgtacatcctcagcttacgaagataacagaattaagagattaaagtaaaacaggtgtaagaaattataaaagtattatttgggaactgttaaatgtccatgaaattttcacgatttatgttcctctgtcatggctccagccagtccctccatttgggatccctgacttcctgcaagaagaaggaatggtaccagcaactctttgtatctctggtagaattcagctgtgaatccatctggtcctggactttttttggttggtaggctattaattattgcctcaatttcagagcctgttattgttctattcagagattcaacttcttcctggtttagtcttgggagggtgtatgtgtccaggaatttatccatttcttctagattttctagtttatttgcatagaggtgtttatagtattctctgatggtagtttgtatttctgtgggattggtggtgatatctcctttatcattttttattgcatctatttgattcttctctgttttcttctttattaatctttctagtggtctatcaattttgttgatcttttcaaaaaaccagctcctggattcattgatttttttgaacggtttttttgtctctatctctttcagttctgctctgatcttagttatttcttgccttctgctagcttttgaatttatttgctcttgcttctctagttcttttaattgtgatgttagggtgtcaattttagatctttcctgttttctcttgtgggcatttagagctataaatttccctctccacactgctttaaatgtgtcccagagattctggtacgttgtgtctttgctctcattgatttcaaagaacttctttatttctgccttcttttccttatttacccagtagtcattcaggagcaggttgttcagtttccatgtagttgtgcggttttgagtgagtttcttaatcctgagttctaatttgattgcactgcggtttgagagacagtttgttgttatttctgttcttttacatttgctgaaaagtgctttacttccagttatgtggtcaattttagaataagtgtgatgtagtgctgagaagaatgtgtattctgttgatttggggtggagagttctgtagatgtctattaggtccacttggtgcagagctgagttcaggtcctggatatccttgttaaccttgtttctcgttgttctgtctaatattgacattggagtgttaaagtctcccaatattattgtatgggagtctctttgtaggtctctaaggacttgctttatgaatctgggtgctcctgtattgggtgcatatatttaggatagttagctcttctttttgaattgatccctttaccattatgtaatggccttctttgtctcttttgatctgtggaaaacaacgttaatcttatacatctccgtcagagcgcttgggtgaccaaggcgcattgtcaatgagcagtaatattttgaaaggaatctttttttttcctgagcagtaggtttcaacagtgggcttaaaatattcaggaaaccctgatataaatagatgtgctatcattcagggtttgttgtttcattgaaagagaacaggcagagtggatttagcataattctcaagggtgctaggactttcagaatggtgaatgaacattggcttcaacttcaaatcaccagctacattagccccttacaaaagagtccacctgtcctttgaagccaggcattgacttctctttagctatgaaaatccaagatagcatcttccaatagaagctgttttgtctccattgaaaatcttttgtttagtatagccaccttcatcaatgatcttagtgagatcttctggataatttactgcagcttctccatcagcactttatgcttcactttgccgttttatgtactgagatggcttctcttcttaaacctcatgaaccaagctctgctatcttcagatttttcttcggcagcttcctcacctctgtcagctttcatagaattgaaaagagttaggaacttgccctggattaggctttgacttaagggaatgtcgtgtgtgatttggttttctattcagaccactaaaattttcttcatatcagcaataaggctattttgctttcttatcatttgtgtgcttactggaataacagtttacattttcttcaagaacttttcctttgcattcacaactaggctatttggtgcaagaagcctagctttcagactctctggactttcagcatgccttccgtacttagcttagtcatttctaacttacgatttaaagtgagagatatgcagctcctcctttcacttgaaaacttagagatcactgtaggtctaattttcatattattatgtctcagggaatagggaagcctgaagaaagggagagataaaggagaatgactggtcagtggatcagtgagaacacatacaacatttattgaggttactaatgtaattgtcttggggtgccatggcagaatgtcagaaggctgtggcaccccaagacactataacctcaaagatcattgatcagagatcatgataacagatgtaatagtaatgaaaaagtttgaaatattgtgagaattatgaaaatgtgattctgatgctgatagacttgctagatacagggttgctacaaagtttccatttgtaaaaattgcaatatctgtagggcaaaataaagtgaagcacagtaagacaaagtatgcctgtatctattaagtgttatagccctagcctgaagaaaaataaatttttaagtaatcatggacatgtggtatgattgtatatcttttgccataagtgatataaaataatatttgagtaaattcgtattatctccaccaaatataagagtagaaacaggctatgattgtgggcacagagggcagaggacgtatctgactggggattgccaagacctgaaccctgggcattcagtactgttgaaaggatcagagagacattagatgccagagtaggcagaacgtcagaagtctggagtatcggtggataatggaaggaggaaagatgtcatatgtcagaacctgctgtggagcaatgccaggctagggaagaaaatgggtctccaggaaaaggacaagtgaccaatgtcccatggtcagacagttgaaggcaacagcagtagctgttgtgacccacactgggaattagatcttgactgttgggacacactaggctaatgaatagcatggaggttaggtgggcagtgatcagggtaagcaacaggtatcgaaatgatttgttatcagcatgctgtgggttaaggcgactaccagcgtgtagatcaggcactaggataaagagtgggcctttcgatcgggagatttaggctgaagccgttctgtgctctgaattgtaattttgcagaggagttgacttaaagttttgggatgactgtgggcattgggcagcacctgagcttgaatcgaagctctaatgtcatgatgtttctgaattctaacatttagaactttatcaaatgaagctttcctataccattcagaagagtactaaggtgaagatagaaggacatggacagagtccagaacctaacaatgaatagctaatatttattcagcactcactgtgtcaggtactgttctgagtgtattacatgtactgcttcatttattcctcctaaaaaatccatttagggaatggacactggctcacagatattctatttaagtaataagacaataagaaggactaaatatgatgtggttaggcataagattatggtatgttccaaactccagcagttccgggtaccaaagtttatctttacccttccttattgttttatggtccatgaccatttgctgttgacgtatttagcacatgccactggtcatgcacattccttatggcttaggttcctaacacctgtctgtgcttcttcccagaccactcactttgacgggtctccctttctgactttccataggtcttattgtctacacgcatttagtcacttggttatattccttcttcctgttttatacttttacaaaaaattgtttaatatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaagtcagctttctcttacagtgtgtgtggtcctgatattgtattaataacttctggattaaaacctgctgtgtactcctgtttctttggcacatagaagaaaacaaaataccttttcattcagctatttatttataaaatgaagacttgattttatgcttccctttggaatacattgtcattcaacttgtaatatgttttggaaataattgtaatatttatatataattttataagtatcttaatcttcatcttattaaatcattgatacaaaaccaattgttcttccactgtatgttttcaaatttgattggctttacttcatatatgtatatacatatatatttaacatatatctatatatacagtttatatatgtgtgtgtgtgcatatatgttgactatacattgggcttccaccttccacctgataatctgtagttttaaggttaaatgaaaaacaggttattttttagggagaagtgggagctggactaaaggatgattagatcttgatttgttttgaatgctacttgcggatgattgaactagagaagtaaattcaaacatagagaagggtgagttttttcttggggtcgataaaaactggttaggtacgtttatgagactagcattcagctctatgaataccccttattttaaagctcctgccaatttccacctacaccattctttgccttgcttactgtgtccttcgtgcttgcctcctttctgcttcacacagtctaaatccctttcctatttgtgactgttcccttagcttggaatgctcttctgatggcttacttactgtatgctgtgtctcaggaaaaaccacaggcctggaagtctggagcatgagtcatagttctgcctctagctttctgacttggccagtcaatttaccacttctctggtctcgttttcttcatggataaaacaaatgagattctagatcagtggttctttctcaactggggatgatcttagtctccactcccacaactctgtttacatttaacaatgtaagtgaagacactttttgttgtctcaactgtgtgtgtgtgtgtgtgtgtgtgtgtgtgtgtgtggtaactgtcatccagtgggtagagaccagggttgctgctatgtatctacagtgcacaggacagaccctcacaacaaaagaatcatctagtctaaaatgtcaataatgtagaagttgagaaaccttgatcgagatctatggtccatttatcttttgtgatttaaaatgtaaacatttaaattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatgcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttctgaggttatgttatacttaaatccaagaacccatacatgttccatctcacttattgggaacttccagcttagtcttttcttttccatttatagcaggttgagtttctggatccagtccgtctgctttctcctacttctaatacctgcttagagcttgaggtagttgggcaaaagattatttttcctgatcatttagactcctgctacaaacttttagatctttaataaacagttaaaaatctttacacatttgatttcaaaagtaatgcatatacattgtagaaaatttggaaaatatagaaaagcataaagaaaataaaaattgctcatgttttcagagataacttggagataaccactgtacacgtcttggtatatatacttctagactgtatttgaatatgtttgtatatattaactaatatttcaaacacagaattatacttctgtaactgagtcttctctgtatccagtataactatgctgtggagcagtgtctagacctcacaattccatcttgcctgactcagtgtagtagcatgccatgtgctttctgaatagctaatatttattcaactcactgcgtcaggtactgttctgagtgtattacatgtactgcttcatttattcctcccaaaaaatctaggggtttgtgtaggctgttgagtcctctgctgcctgtctgcccaggttctcatccataacactctgcttaccccttctgtctggggcattttatcgatgccatctgctgctcatacactggtgactcctgaatttctgtctctagttcagacttccgttctgagcttcagatctgtgtattcagtttctactgcacatcttcacctcagtgttccacagtcacttcaaactcagcatttccacacctaaggctgctacatgcacccagcaaatatatgcctcctagtgcatttcctattttggtgaatatatcaccatccatttagttacctaagccagacactggggaaattctaagtgtcttccttctttctagttccccacatccagtgaagttgtataattatatctaatctggcccctcctttccattcttactgccctgatacttaagatctttcatttttctctgcctgcagagttttatttcttttcttagcagtcaccactcctttagtcttaccctccctccaatccattccctatcttgttgccagtgtgatgattttaacatgcatatttcttagcaggacatacaaaatacttttttttttttttgagatggagtctcgctctatcgcccaggctggagtgcagtggtgcgatcttggctcactgcagcctctgcttcctgggttcaagtgattctcctgcctcagcctcctgagtagctgggactacagccgcataccaccatgccctgctaatttttgtatttttagtagagatggaatttcactgtgttggtcaggctggtctcaaactcctgaccttgtgatccacctgcctcggcctccctaagtgctgggattacaggcatgagccactgcgcctggctaccaaagactttgagaactacttaggtagctacctgacctcatctgcttttatttttattttatttattttatctattttttagtttttactctacagacctaggaacttgagctttttaaaatttttattaaaactaatgttgagttactggttgtttctcttaagccccctgttgttttttcttctctcttcctttgcacttgctatctgggtctctctaccctgtctgattacctggtagactcctatttcttcttcagaagattcccctgtgaaactcttccggaccctccaagcagactcaggcagttctttatcactattcacgctgcaccttttaaatcttgaaagttgtactgtaatccataactcccaccagaaagttgtcaaaggcagcagatctttaagctgttccacagaatggatccctaggacctaatattgtatcaggcagtatttatgaagtgcgtgctgttgagtgaatttaccctttgctctcacttagacagtgtcctactgtctcaggaaggggatttccctctctcacattaattatttaggttggtctgattttattttccttaaaaaataggttaaaatggggagaaactaactcttaacttgaaaaagtccagtgctcttagagggtacctgcaaatttatgtttcctgtcatggcaggaggctgagctaactaatggctaagtaactcttttagctttattgtcagcagctgctgtgaatttttacaatagttttagggcagtgaagttacactttattaatttcaggttgaggatgttgatcaagatgaaaaattaaatcgctgatactttctaatgagagtaagtgagcttctgttttcagaagtgaagaataaaggaaagggtgaagagaaatatattaaaatacatttttcttgcatatttaaaaagtaacatatacttaaaaaattatctgcccttttgaatatagggcaggaatttttagctatacagaagcataactgtctgcttaggatttttaaaggataatttgtatttaaaataactaaaagattatgttgatatagttcaatataacaatcaagtcacactgcattaaatgacatagcaaagaaaacccttgtgccagatcagttcgctttctggggagtgctgaatgttgagtgggaaaggatcaagtcagcaggtggcagcctaccctttgaaatgagaacatccctgttggcattgtgccagcacttgaactgctgcaaagcattttatattccatcagaaggcggaatttgaaggattgtgggttactgacatacgttgtaaagctgaatactacttgatatgacaaagaaggaattgcataattagaggcaatgctataagaaaaggaagagaggcatagagcattttgtattccagacgatccagatgagtgtggatttagtaccactaaactgcttctcttccttgtcctttgatagaacaaaatagtatgagtgctttgaaaattagaagaaagaaaatagtatgtcctcatcaacattgcattccaaatggcagctttaaccactgtacgtaatgagatgtattgattaggagcaacagctggacctctggggaagcagggagtgggagagggcagttaaaggtagttgatttgtagggtatgtgtgattttatgttgaatgccacacatgctttctttctttcttttttttttaagacagagtcttgctctgtcacccaggctggagtgcagtaatgcgatcacggctcactgtaacctctctctcccaggttcaagcaattctcctgcctcagcctcccaagtagctgggactacaggtgcccaccaccacacctggctaatttttgtatttttagtagagacggggtttcatcatgttggctaggctggtctcgaactcctgacctcaggtgatctgcctcccttggcctcccaaagtgctgggattacaggcgtgagccactgtgcctggtgtcacacatgctttcattcatataagtaatgagacagattcctcatggcatataaaaaatccattcgtattgtcattctctgagagagagagaaagagaaagagtgtatgtgtgtgtgtgtgttattaaaataagattttggtgtgtcaggtttaaggtatgtttgtaacattattctatactgatataacttgcctggttgtggttcttagtgtatatttggcccacttattggaggaaatttaggtgaggaaaggaatagctgaggacctcctgaattagtctacaggcctaaacatgtgccttttcatgggacttgatgtttttccattactgtatccattcctttacaccacaggtgtggcctgtcatagcagcttgggaaaactaatataaccacttacttgttttcttatgtaaacatcactgaaattgtataaccagatactttaatacactgaagtcaggttggaaaactaggacaggcatgcggtgaaggcaagtttttgtctataatatatcaatatttgggagttgactttgggcctcagtatcctcatcagtaaattgaagggaaaggactaggtggtcctctgggattcttccagagcatacatttaggtaagctttatggttttatttgtttttaaaaagaggaacacagttttttcatgctttgattccctttacatttagaggtttttttgaatatagttgttatagcattttggaaccatggggtaccttaggcatttaatttaattttttcttaagatgtcccttttccagcgttttgttttattttatttatttatttatttatttatttgagttggagtctcactctgtcacccaggctggagtgcagtggcgagatctcagctcactgcaacttccattccccaggttcaagtgattcttgtgcctcagcctctgagtagctgggataataggcatacaccactatgcctggctgatttttgtatttttagtagagatggggtttcatcatgttggccaggctggtctcgacctcctgacctcaagtgatccgccagccttggcctcccaaagtgctgggattataggtgtgagccaccacacttggctgcttttccagcataagttttaaatttaggggtgttagcaaaatctttgctctcttatatattttttgtgaattatgaaattaatgtctttaacagagaaagtgatcttccattatatgttcttgttgcaaagaacgggttatttgggtgatactcatactcttggatttagtgtcagggttccattgtagaatggcaatctgtgagatgggggtttggtttctgggttgttgaaactaattttatggaagaaaaaaacaggataaaattcaggaaaattccttagggaaattgaatatgtagaggatttatttcccctattgaagtatacatatttatgacatacaagcagattgaataccagatatagattgtgagatgtctaacaggaatttggagtgaaaacaggtattaataagttggtgtaaatctggtttcctaatatatttattaaaaatatttttaaaggattgttagtagctttaaattgctcttgatattacaaagttcttttgttttccaaaggtgcacatgttggcagaactagatgaacatgtttaatatgcctttttttccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactgttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggactcacagttctttttttcaaaacttactgcaaagctgtagttatcaaaacggtgtgacagtggcaaaaagacaaacattgatgaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccatatacaaaaatgaactcaaaatagatcacagacttaaatgtaaaactataaaactcttagaagaaaatgtaggggaaaagcttcgtgaaattggatttgataatgactttttaaatatggctctaaaggtataggcaacaataaaaatagataaattggactgcatcgaaattaaaaatatgtactttgaaggacactattaacagggaaaaaaggcagttcacagaatgggagaaaatacttgcaaatcatgtatcagataagagattaatatccagaatatatggagaacttctaaaactctacaaaaaaaaccccaatcaattaaaaaaataagcaaaggacttgcatagacatttctcccaaattgataatttatatataaattaccagtatataaattaccagtgaaaagatgctcaacatcatcaattattaggaaatgcaagtcagtatcccagtggaataccacttcgtactcattaggatggctgttatcaagaaaacaggaaataacaagtgttgctgaggatgaaattggaatcattgtgcattgttggtgggaatgtaaagcgacacagccacagtggaaaacagtacggtagttcctcaaaaaattagaatttccatatgatgcagcaatatgcctttctttttatctcatttaaaaaatccagctgaatgagttagcatagaaaatggaatggaaatattgatgcatgcttcatttactttagtttttcttatttattactttgatgaccttttgtgatttttccaaataaggattttagacactactaaaattagaatgggtacaaacggtcactgtattttactttctctaatttataacactgacctctcagaactttagttctatatgacgtggatatagactagataagaatttctcagcctgtcagcactatttatttatttctctatttatttgtttaagagtcagggtcttgctctatttcctatactggagtgtggtggtacaatcatacttcactgcagccttgaactcttgggctcaagcagtccttccgcctctcacagtattctcactgttggcttgttgaccagtggcttaacaaataccatttaagaaaataagatatttaatatattttgtaggatatcagagctggggagaaatggagggtatatctagtctagtggttttcaactgctggtgattttggcaatgtctagagatatttttggttgtcataccttggggggtaccactagaatctggtggatggagacctagaatgctgctaaacatgcacagggcagccccaccaaataactgtccgtaccaaaatgtcaatactgttgaagctggctgggcatgatggcttacagttgtaatcctagtgctttgggaggccaaggtgggaggattgcttgaggccaagagtttgagaccagcctgggcaacatagcaagatgaccccacccctacaaaaaattaaaaaaaaaaaatagctgagcagggtggcacacagctgtagtccacctgctttggaggctgaagcaggagagcccaggagtttgaggctgcagtgagctgtgatcataccactgcagtctagcctgggtgatagaaggagacccagactctaaaaaaaatagtgcagcaaggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcgtcatctagcattaggtatatctcccaatgctattcctcccccgtcccccaaccccacaacagtccccagagtgtgatgttccccgtcctgtgtccatgtgttctcattgttcaattcccacctatgagtgagaatatgtggtgtttggttttttgttcttgcgatagtttactgagaatgatgatttccagtttcatccatgtccctacaaaggacatgaactcatcattttttatggctgcatagtattccttggtgtatatgtgccccattttcttaatccagtctatcattgttggacatttgggttggttccaagtctttgctattgtgaatagtgctgcatgtgtgtgaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccagcaacagtgtaaaagtgttcctatttctccacatcctctccagcacctgttgtttcctgactttttaatgattgccattctaactgctgtgagatgatatctcattgtggttttgatttgcatttctctgatggccggtgatggtgagcattttttcatgtggtttttggctgcataaatgtcttcttctgagaagtgtctgttcatgtccttcgcccactttttgatggggttgtttgtctttttcttgtaaatttgtttgagttcattgtagattctggatattagccctttgtcagatgagtaagttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcttgaatggtacttcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatgtctctgttttgggaccagtaccatgctgttttggttactgtagccttgtagtatagtttgaagtcaggtagtgtgatgcctccagctttgttcttttggcttaggattgacttggcgatgtgggctcttttttggttccatatgaactttaaagtcattttttccaattctgtgaagaaagtcattggtagcttgatggggatggcattgaatctataaattaccttgggcagtatggccattttcacgatattgattcttcctatccatgagcatgaaatgttcttccatttgtttgtattctcttttatttcattgagcagtggtttgtagttctccttgaagaggtccttcacttcccttgtaaggtggattcctaagtattttattctctttgaagcaattgtgaatgggagttcactcatgatttggctctctgtttgtcttttattggtgtataagaatgcttgtgatttttgtacattgattttgtatcctgagactttgctgaagttgcttatcagcttaaggagattttgggctgagacaatggggtttctagatatacaatcatgtaatctgcaaacagggacaatttgacttcctcttttcctaattgaataccttttatttccttctcctgcctaattgccctggccagaacttccaacactatgttgaacaggagtggtgagagaggacatccctgtcttgtgccagttttcaaagggaatgcttccagtttttgtccattcagtatgatattggctgtgggtttgtcatcgatagctcttattattttgagatacgtcccatgaataccgaatttattgtgagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgtcagtatttttttgaggatttttgcatcaatgttcatcaaggatattggtctaaaattctcttttttggttgtgtctctgcctggctttggtatcaggatgttgctggcctcataaaatgagttagagaggattccctctttttctattgattggaatagtttcagaaggaatggtaccagttcctccttgtacctctggtagaattcggctgtgaatccatctggtcctggactctttttggttgataagctgttgattattgccacaatttcagctcctgttattggtctattcagagattcaacttcttcctggtttagtcttgggagagtgtacgtgtccaggaatttatccatttcttctagattttctagtttatttgcgtagaggtgtttgtagtaatctctgacggtagtttgtatttctgtgggatcggtggtgatatcccctttatcatttttaatgcgtctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggttgttctggggttggagctacttctgtaaccattgttttcaatttaattgattacacaataaatgttagagctaccaacaggtgttctctttgacattttaagtatcagtcagaatgtaatgaccttaagccagtttttctcaatcttatttgacaatggcatgcttttaaaaatgttcaaatgtgagcaccaataggggcttggaagataggcttggattaaagtgaacaaggaaaaatgggattatagataattattgtcagaaagtataaaattgattcatgtatcttttaagcatcacaagaattagaaaatgagaccatgtgtattttattaagaacaatatgtattagaaaagtaaaagatctttgttttatattttcattatcaaatatgacatccacatcctcaagccacacatccacgtaatatgaaagatgttgctaaattagtttcccaaacctgattcttagtcttctgaaaattctcttctagactggtgcctttaacagggggaggaacccagacatttttttcccttcagtatttagaatttcttgaatgagtacaccctagatattttaattgttttatttttgacagctcagtttctaatttttgcacatcaagaccagtgaattttcatttcttatgtatttggagttgcttgttttttgattcagatataatttttggattacaagcctgttcttttgctttaaacttcccatttcaaccatagatcttgaggaaatctatgtacgtagttgaaatttattttattgagtaataagtgttagattataaaatcaaataaaatacaaatatatattgaaattttaagagagtttaacatataatgttatccactaaaaagatgaattatgttaatcctaatatgagttataaatactgtctatctattattgctcaggttgaatgtcaggtaatgtgtgacttgctgccattcctaggtatagctgacccatacgtaaaggtagagtagaacatagaactattaagtactatagctatatatttagcacttttctttcagatctaataataccttttagaaggccataggagtccctttgggacacaggaatgggaataaaaacatataaaaataatacaaagttggggatttttacacatttgaaaaatacagtagtgcttactctgactctctctattcatgcttttgattaccatgctgcaatattggctgtgttgggggaggaggagtattgaaaaacattttgcttttgtgtttctttgacctaactttaagactattaagtttatttatcttttgtcagagtcatttttcttttctaaagaaaaaccacatgcagtgaaggaattaaaaatgggcctgctgccactgctattttggagattcttagattagcttagatcagtccagttatgaaaaaatttttttctctttcaaacagtgccgcatattccttgatttcaatttctcagaagtctgggagattatcagtgtaacatttctaccaaatttctcaaaattaaaaagaaatccagtgaagagtatcaataaatacagacaatttagattcctaaaattatcagggctgaaaaaggatcagtataacaattttatggagcagttcagattggtcaatatctggggatgcttggattctcccatcctgttttgttcatcttaaaacagatcacaaagtccgttaaatttcaactgctcctctttctaggagttgcatgtgtgatagccatagcagctgtatggcaacttcacgttgacactgtgctcagacattgagttgatattgtcacttacctgaagtcacttaactgtctcaggaagtttgaatctaaatgtgtaggttattacacagcaatacattctgtgcctctaattctgtcttggaaatccactgttatcacctttaatgcagttataaagtcacataatcataaagttcactaggaaaagttattttccagtcagactaggaggagccaataaaaacagctctacgtggaggacagtattaatgtcatttgccagatatttgttgagtgagactgcctatgcaaaagtcatagagaattagagcacagtgctttgttttctgttcccatttaacatagatgagatttctcagttgctttgattggcagagttgatgaaggatcagttaggtaaaggttggcaaatgtcatgtgctaagaaatcacttgtgaagcttgttggacaaaaagttttcagtttcctggtgagcagctacacccaaaggcggctttagcagtgaaatgcttgaccttctcttgtggcatcctgccatccttcccctctagatcctctggccaccagccagaagtggtggcatctagccaatcataaattagtcagaggattcttattctgtaatactggctcttggaaactctagtatctttagtaataaggaatttcttctccgtttctgggcatgctgttcatttaacccatcttttctgttttctggtctttgccagcttggagtctagcagaaacaaagaaacttgtttctaagccaaaaggaaacacacaaacctagtagtatatccttaatcaatatcctatagacaatgaatttgagcatttctttctttaaaaaagtggatgttcctcaaaactcaaaaggaaactcaaaatcacttcaggaacatcttaattctgtattcaacggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacattgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttcagttttatctttgtagatccccttctgctattgtttgtgtctgttttggtttctaatttctgccaaactgctaagggatttgatccaactgttagcatttgatgtgttttttcccttccagatcacatggactctatctttctgttgtgaatctctcttgtggaggctttagcagttagttgggcagggtcttgccttgcctgtcctcttctttattgtgcacagccatgagtggactgttgtccatcctctggagcatacacacaaaagcctgtgttgatggtgcagtaacaacatatggatcagtggtccttgcctttgctaacattgtggtatcaggagtgcttgaggggactttcccccaaaccacctcatccatacatcaaatctaagtaaaaacaatgggcttgctatgaacatgtaagtttaacacaagcccactggcttttgtttccaactagaatggttctttaagctgctcttatagatattttggagcttctgctgcctggcaactcaactctgtcagtttcatttagttgggtcagttttatagtttctgcagaactggaagctggccatttaaaatagccttggttccactgacacatgtgatgtgattgctggaccaactgttcacaagttgtgaagagattacaagacagtagtgggctgaaatatgctcagtagagaaaggctggtgttgactgataccattaccacattgaccagtgggtacaggaagtaggtagttactgttgaagtataataaacaccaccaggctttgtctaggctaaggcacttctttagtatgccctgggatctcttgggttattttcctggttacagagaccaatttattagctctaagagcttgttggagatgccatcctaggaaggtagatgccttccagttgtgtgtatgtgtgtatatatgtggaataaatatttgaaatgggtttcagacagctacaacactgtttgcttcacagcactgcttccctaccttgcccatatgctgcaatactgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgacagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaaggcttaggaattggcaacatcaagtacttctgggaatagggatgaatggagtggggctttagaatagggagaattggttgaaaatctttttaagagcccctcagatctctagcttccctctaccacctggaagaatctggaggttaattctccaaggagaatgtattaataaaatacatctagagagaaggaaggctgggaaatgtagtctttgttctgtgtggacatgtgctcagctaaagctctggggttctgttactgcgggagaaggggagaataaatactgggggacaattagcagttggcactatgcttacatacacacatacttgctacattaatataataatattgataatgatattgatggtgataatagtagcagcaaagtcttagagtgctttttacatgcccagcactgttcttagaactttacatatattaactcacttaattctcaacaatcctgtaaagttagttctattcttatcccactttgcagatacagaaactaatgtacaaagaggtaaaataacttccccaggtttcacaactgaaaccaggcctgagacctcatctttctgtgattaaacctgacattgtgattaagtttgaagaaactgattgctaattaatgttgttcattgtattggttttgtgttctctttgaagaaaatagtagtgatatatgtgctcaataaatataaggagttattgctatttttataaaattatatgtttgtacaaattcaagttgcattagattacaaataatttaacctttgatgtctattaactttttatgtttaaaaaaggttcatacattttgaagacaatcagagaaggtggtaagttgagtgattaaattgtaatttaaaacataactgtggtcacagtgtagagaagctgagactaaaagcagggagacgggggtgagatgatgcctgagtccaggcgttgtgaccttcggtgtgcgtcagaggcccctggaatgcttcttagatcatagaatgctggatttcaccctcaagatttctgatttagtaggtttgagatggggcccaacaatctttactgctaagaagtttccagaagcagcagctgctgcaggtctgagaaccacagcacctatctgagaggtaatgagagtctaaattgtggtagtggagggaagggataggtgatgaggcatcagtcagggagaattgacaggattgtgattctttgaagttgaggtgaatggagaggcaaggatccagagcagtggtgaggggttacacattgaatgaaattcctgttggttgttacaattaggaggccattggtacttgctgacctcaataaaagcaattttcatggaaaagtagggtcagacatagattagaaaactgagattttgaggagataggttaaatcctgtaatatattgtagaatacatttagatttctttagttctgaaatgcttgattatactctgtatcccagcttattttagcaggccatctgatactgaccaaactaatgcttccattgtcttcatgatactttctggctttccactcaccttttgcttaaaagtggtcctgacatttttaagaagtgtccatatctactttatttcaagtgaaagtcatccttctgcatatatgcttattagtttcagatcagtgtagaaacctttctgcttgcattttcttctgtatggtgacttttgagctctttctcttagatcctgcttttgggtcctcaaaacagctcagatttaagacgtcagagctgtcaagctctgctggttttactttggggtttctttcactattgttcccattgccactatcatagttcatgctcccagtacttttgatctgaatgattatagcaattatcatgagtctttgttctcactctccttcctagtcttatttaatttaaaaatatctgtgagattgattttccaaaataaagctctgatcataacacttctttgcttaaaatcttctcagtgtttaatagtaaagtccaaataagcaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaagcctaggcattaccattcaggacataggcatggacaaggacttcatgtctaaaacaccaaaatcaatggcaacaaaaaaccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaaagaactcaaacaaatttacaagaaaaagacaaacaaccccatcaaaaagtgggcgaaggacatgaacagacacttctcaaaagaagacatttatgcagccaaaaacacatgaaagaatgctcaccatcactggccatcagaggaatgcaaatcaaaaccacagtgagataccatctcacaccagttagaatggcaatcattaaaaagtcaggaaacaacaggtgctggagaggatgtggagaaatagaacacttttatactgttgctgggaccgtaaactggttcaaccattgtggaagacagtgtggcgattcctcagggacctagaactagaaataccatttgacccagccatcccattactgggtatatacccaaaggactataaatcatgctgctataaagacacatgcacacatatgtttattcacacacatgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagaacacatggacacaggaaggggaacattacactctggggactgttatgggatggggggaggggggagggatagcattaggagatatacctaatgctaaatgacgagttaatgggtgcagcataccagcatggcacatatatacatatgtaactaacctgcacattgtgcacatgtaccctaaaacttaaagcataataataataaaaaaaaatagtaaagtccagttttcatagcttagtataagacttttgtttctagcttcaagttttttcccccatattcttggctgcacccacactacccaccagttgtccccagtcttctctgcctgtctgccttccttatgctgctctgtccctcagaaggccctctctttccacttcaaatccaacctctattctggaccctgctcatcttcttatagcccttgctatctagaattccttttaactattgtctatttccatctagtactgtacctgtaactcagtatacttattttcaaccatgtatttacttatatataatattcaccttcttgtctcccacgatgcccataatagtgccaaacacaaagattggttgaatgaatgaagaatgggaaaccagctaggatatagtgcaaataaaggaaataaaatgatgattcatttaactgatacagtaaatatattgcatatcagtgaatgatgtctaatggaattttctaaagctaatatgagtgacagtaggaacctcttttaagtatagtcaatcaagtttgtcatcttttttttttttttttttttttgtgagatggagccttgctctgtcatccaggctggagtgcagtggtgcgatcttggctcactacaacctctgctttctgggttcaagtgattctcctgcctcagcctcccaagtagctgggattacaggcgtgcaccaccacacacagctaattgttgtatttttagtagagatggagtttcaccatgttggccacactggtctttttctcctgacctcaggtgaccagcctgccttagcctcccaaagtgctaggattacaggcgtgagccaccacacccagcctcatcttttttgattgttcagaaatcttttttatttaacttcttagcttttaattgagtcctagatatttcagtgagctgaatactgtccttaatatatgtgaaatgtcactgttatattatgccatttttaataagcttgttaagcatcacttggatgatacatgtgcatatatgtgtacttattcacacatgaattcacatgtattttacctaagattaatatgggccaactgtgttttctatacaatggaatattattagatggactaatggattcactagcctgattaatgatctgtaccagttaatttctgcgttttgatacatcttattgatgtgttttctgattctatttttatttactcattggagtgtgaactagaaaaatactatacacaagtaattagattgtagaagtgatgtgtaagatttgtttgttataattgattttagatgcagaaacatttagagctagcataagaaaagttgatgtaagttatgaaaattagaaaacatttcagatttagaatataatgatattatttaatttttaaaactaactttttttttttttgtttttttgtttttggccaaacattaatcatttggggcttttaaactgtattgcatttgggaccgcctgtatgtgggcctttagttagttccagtagcagtgagactcagatattttgaaagaacaatatcagatatagttagtgaatattgcttattttcaggttaaaactgattcttcattctcttgagctttcttttattaataggtcctcagtttggacttagaattcatttaatgtcaaccttctcttgtttacaaaggggaaagctcatttatttttcatgctttgtcatattgttccctttgtttctgagaaaagggcaccagcctatttagatagagcagtttaggctatttataaagctaggcaggttaattgaaattgacagcttggtaatgtcctccttggtgaatgacgcacaagggttttagatgatgttggcatgctgttttcacttatagtcaggaatcagctggaggaatttgtgtgctttgagctctggtgttgacgtaggtactgggtacagatatgttttaggaaacatctcatttccatataaatgaaggaagattaaaaagaaaaatttcaatggcttgcccttaaattgaagctggtatcacaaggatgatgataatacttcttttgattttctggaaaaacagctttggttgtattcaagcactgtggagtcgttacaggtttattcagaaatatttttgtattctttttttttttaatctgtttattcagcatcagctatgtgtacattaatttgaaaaactacatttttattgtgtattcctccaaactccaactttaatctcttaggttttagattgctccatttaagaaatttgtacaggtacataaataaacttgattttaataaaagatagaagactgaaatagtttttctttcttacatgacaagactgttattctttcttttttaaggacatagtaaatatcagtttgcctgaaatgagtttttgtgtttttctcttcaagtgtcacttaaaggagaggctaacaagcttaaatagtcacttaaatgagagtttaatttaagcttaactggttatgtagtcatattccctgacacccaaacatttaggtcataatcatttgtttcattcatgacagggtgatttccaaagtacagacattttatctcagaatcacattgagcatgcacggaagcaaattttagcttacataaagttaagaaacactagtagttgatttattattagttgtaatatatcttctatgggcccatagccttatcaaaactagcactgacaattcctgaagatatctggggctcttggcatggtgagttggtcctgtacttccaggttcatgctggtacctttgtggatcatcatgtctgtcatatggaccttagtcaaatgttatggcaaacagcacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgagcacagtacatgcctagtgagatcttccagctgatggtctgggatccttaaagaccatgcaacgtcctcagtacttctcagtgccaattgtcaggggatttttggctgccacgtgcctctcaactaacaactattaagtcctgttggttctatagtgtttctcaaattctttcttcttcttattttcctcaacactatcctgataatagcattatacatcttataaaatgctttatggtttgcagagcacttgaatgtgctttatcttatttgatcctcagatcagctctgattgatagccaggttagttatttttatcctgattttgtggatgaggaaactgaagcacaatccaacaccacacaactggtaaatggtggaaccagatttaaacccatgtatcgtgatgccagagcccatgcttttaagcactgtagtaacttgcttatatacaccaaactttctatctttatctcccactactgtttttaatcctcttatacttcagccttcttggtttgcttcccaactcagagtttgcccttatttcctgcctttggtcacactttaccttctacctgtgcctgtcgaaattctgcccattcttcagtgcctaattcagtgtcttctttttcataaaactttgtatgagtcctccaagcccaaaagaattcccctctcctctaatagcattttatttgtatgtcattttcttacatcataattatatttgacttatcgcattgtaagttgcgtgaggacagatggtgttttatttatccctttatcatttgtagcaactaactacagtgctttgtacatggtcaagtacatatgaaacaaattatatcaagtgatattttttactgggtcagaatcagagcctctggtggtggcaagaggtgatttgagagagcttgatactatctcttacaacatctatctaataagattaggaaggtatatttgagagactattatcttcagtttgctccccctcctaggacacaactaattcattaaagatcttatctaagttgtgacaaacagcactttgttcatcttaagataatttcattccaatgttccatatttttagtagtctctaatctagtaattgataatagtaattgaatttcttggcaaacaaaagaagacctaaattttaggtatcaaaattatttttattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggagattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaattttaggacattgtcctcaaagacttattacattcagattagctatttaaaactgttttgtatttgtggctgtggtgccagataacaaggtctaatttaatatattttagcatttgtgacttgagtagtttgcaagagacaatgtaggaaataaatttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtgggattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaatttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaatagagcaacttgtaacaatcattagaagtaagtgtatcagtaagtacaaaaagaattttctatacttgcttctagtgataattgaataaggcacacatataatgcagaattcaatatggctgtgataccaaccatatctttaagtgacttccttaaattagtgttcaaggactgcttgttagtggttttgtttggaacgaggtctgattatccttaactggttaaggaagccatgaggttatcagtactgttgtgtacagtgcatttaggtgaataggtattcttttcattagaatgattaaagtaaaaacaaaaacagaaagagattaaatatattatcaaactcaaagctttgttggtgttgacatttcagcagaaaaccgttgttcattatgccatattttttactgttaatttgaatttaattggttaggtagttacttttgtatttaatttataaatttgttttggctttgtctttttatcagggtaataaatgctaagttttgttttgtatgtattaaaataacatattaaaagtggtttaagttggcattaggagtgtaagaacacatttttcccttaaaagttgtatatctagtacttggtttgagaaacctcagtctatgatactgaacattattgtatcataatcatgatagctaaccttcaactagatgttttctatttcattttctatgggttgcttaaaattgtgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaatgaaaaatttcatgtttatattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctaggcagtaaactgtgacgattaccttgatgacaggattgcttattcagtgttctttttcattttctacctctggatcatgagtagcctaatttacgatgctaatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctttagttgaccctaaaacaaatgcgttttatctttatcaaatttttcatcatcaagctttaatatattgtgaaatcacaacatattctatcaagtatactatgactgaaattactggatgtattatttatttctgtctcccactgttacaattgtgtctataatgacttttatttccctggtttattttgtagcttagtcacaaatatttatgttcttatttatctttctgctcagagactgggacctgagctgtttccctgatggagtcaatcattttccagaaggatattccgacctattcaaatctaggtcctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgttagatagggaatagggttcactggtggactcaattttacccatttctaattgcttagcaagaggagtcacctgctgattttaatatgaagtttagtattgtgtaatggacaatatctttaacagatggtgtactgccagtgatgtagaacttcttaatcatgctccctttacaaaagaagaacactattagaaagcgatggtatgattttatacttgatcttcaacaagtgagaaattgataagtcaaatatacagtcagccatctggcattccacacatgttttcattgacttgggagatcatggagttatacaaagcaggagtagcacaatataagaaaatggcatgttatagaaatatttatttcttttattttagttatctatactattgatcagcaacaagtttatcagaaattttcattttattcagctatctgagtttagaaagaagtaattcagatggtatttacttttttttgcccaatcaaagctgctaggcattgaggaactgtttcagagtgggcatagttttttccttcacatgaggtcaaagccactaaccactgaattaaacatttgctgagcttggtttgcagcactttgattgatatagattccttcttgcaacttctttgagcctccgaaacttactgtgtcattatagaccccaactgcctttaaaagataggaatttcaacatcctacaatttagtcatcatttggatgaatgacttaaattattatatattttaggaatattaattttttatactacctgagctaagctgtgtgaaattattatcttatgacatacacactatttaatatattgaatttcagaaagttggttccaaatatcaaatagctgagtagaaagtagaaaaagacaatccagttgctgagaatggggcagaaaaaaaaaatgtgatttctaaatccaaagaaactagctccccttatctaatttatcctttcaaactaaaaatatgttaaatgctgtcagtgtgccgggtaagtaagtgctaagcactgacactccccctccttgtccttatggacctcaggctgatcctctttgttcccagcctggctcactgtcactctctccagcattcctgtcagtgtccacatggatggtcttttcaatattctggcttctcagcttcttatccttttcttctctggtgatcttatcctccatcctacatcagcttttcattcttacagccatactcttgtcattagcaataacagtggtctctgcataatctcagtttgaagcatcctcaactctgattagcattttgaatctcactgtagctcactgcttctagtacctccattccaacaatcttttgaccttattgattcttaaaagccacggattttaccaccttgttgctgtctttcatttccctgattacctttctttcttttacatccagtttaaatttcatgtcaatatttgcttggcaaaatctaattctagttaaatccatctctctgtgtaaatcctgagctgaatgtcactggagcaaaacatgccatgatgcaactggtctttaagttcaaggctgggaagttccggggcactcatgttgcctgccatcatgctgcatgttccgggtccattcggtcttccattctcccagatgactatttcatacttttttccccctcctcaaaacagcttctcccatccttattgttaggtaataatttagttttgcattttactgaaaggatagatgccactaataagaacttggataagctcttatcactgcatatatccatgtaccaccatcaatgcccatatgccttctttcctcctgcactctgaaagaatgtaagggttcctatcaacccctccacagtagatcccttcttctcttgtcaccttttcaaagacacggttccagttattattccttctctccattttattaattttctcaaaataatcagtgttctcttctctactgatcattcccatcagcctgcaaatatgctgttattttttccatcttaaaaacctgtcttgctgggtgcagtggctcacgcctgtaatcccagcactttgggaggctggggcgggtggatcacctgaggtcaggagtttgagacaagcctggccaacatggtgaaaccccatctctacgaaaaatacaaaaattagctgggcgtggtcgtgggcgcctgtaatcccagctactcgggaggctgaggaaggagaatcacttgaacccaggaggtagaggttgcagtgagtggagattgtgccactgcattccagccgggtgacagagcgagactacatctcaaaacaaaaaaacccaaaactctcttgaccccatattcccctctagtgactgctccctttctcttctcttctctctctctcttttttttttaagacagaatttcactctgttgcccagggtggagtgcagtggtgccatctcagctcactgcagccttgacctcctgggttcaaatgatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgttattaaatgctgtctttatgctgaagacttccaacttatatccaacagtctaattgatagctctacctgaatatctgagggcatctcaaagtaaacatctccaaacctgagctgctgatctctcacccaacatgcttcttcacagttttccctttctcagttactgggaactctgtccttcaggttacccaggccaaaagactttgaatcatccttagtattgctgtgactcatactgcacatccatttcatcagcaaatccttttagctctatctttagagtatatccagagtctcacaccatttctccaccttctctgctattatgcattgttatctcttactgggattattgcagtagcagataatcaatcttgctgtgtccacccttgctattgacaggctattcaccaaatacgagtcagaaggatcctgttgaaatgcagctcagagaatggcatgaccgtactcaagaacttcctgtttttctcactcacctgctctctgactcgctctcacagtaaaagagggtttacaatgtcctccagggccctgcttgatcatctacccattccatcctgtaactccttgactttatctcctactactctttcttttactctagaccaggcaatctggactccttgcccttcctctgatatattaaacattttcttaccccatggtttttgtacttgatggtcgctctgcccagaatatttattctctcagatatatgcatggtacacatcctcatttatttaaaccctttgcttaactgtcacctctcagtggggtcttcccaatgtccttaaaaatcatagtagtttccctccctccatcacctactcccctggttcatcatctaacaaactaaatatttccttcatttattttgtttttattgcatttcttgtgactagaatgtaaacattcatgaggaatgttttcgttttgtttgctgctgttaggaaagtgtctgtataatattaagtagtttaaaaacatttgttgaataaatgtatgaattattatagtcttttcagtgttataatttttctattacacataagaaatggagccttagagtgtttagtaatccgtggaggtaacacttaaacccaggtctttcttggctcatagtgcagtcactcatgtattttttcatctatcaggacacttacagggtactacaggaactttacattggatgaattgcattataagatagaggaagtcatcaatattgtgtgtcttatttgtgctcttctcctcaatcagtatctgggagaaaatagaaaccgatttttaacagttcatgttgaagcactttttgctacatcatagaaacttgtcagagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaattttagctgtcctgactcatagactggggagtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttacttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaagactagtacattaaaaaatcatctcccactatgtggtgattttgtccatttgtccttttagttgtgttgcttttttccatttatttggagcccattgttagataagtatagatttagaattatttatttcttgtgaattgaaccctttaacagtatgcgttttccctctttatctctggtatgtttttttcctgaaagtctactttgcctgctattaatatagtgacatcaactttcttttggttaggttttttattgtctattttttccttcttttttcttttttttaacaacctttctctgtctttagagtttgtgtttcctttcaaatagttgggttttcctttcttttaaattagtgtgacagtttttattttcattgaaacattagattacttacaattaatacaattattaattggatttaaataattcaccttactatttttttttaatagagacaggttttcactatgttggccaggttggtgttgaactcctggtctcaagtaatcctcttgccttggcctcccaaactgctaggattacaggtgtgagccaccgtggctagccatactctttattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagcatatatttaaagatctaatagaatagtttaagcagatagattgggattgggtgaagtggctcacatctgcaatcccagcactttgggaggccagggtgggaggatcacttgaggccaagagttcaacaccatcctgggcaacataatgataatgagaacccatatctacaaaaactacaaaaattagcccagtgtggtggcacatacctgtcatcccagttactctggtggctgaggcaggaggataacttaaaccaggagtccaaggctacaatgaactgtgatcgcagcactgcactccctgggtgacagaatgagaccctttctcaaaaagaaaagaagagagaaagaaagaaagagcgagagagaggggagagggaagaagggagaggggagagaggagaggagagaggaagggaaagacaagaccctgtctcaaaaagaaagaagggaagggagggagggagggaaggaagaaaaggaagagagggagggagggagggagggagggagtgatgggatcctgtctcaagaaagaaaggaaaggagggagggaaaagctcattgtgctatgggaaaggaaggaaggaagggagggagggaggaaggaaggaagggaaagactcattgtgccatgggaaaggaaggaagaaaggaaggaaggagggagggagggagggagggacgagaccctgtcttaagaaagaaaggaagggagggaaagacttattgtgctatgggaaagaaaggcaggcaggcaggaaggaaggaaggaagagggggagggaggcagggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagttctttttgaaggaggactggttttataaactctggcattgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcctttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgccttctcttttcctccttcattttctttcttcctcttcctttttcctttttttttcagctgaaatgaaaatatacttaaagtacaaaaggctaatatgaagaaagcagatgaagggaacttaaaaagtaggaacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacattagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggactatccacacttttgtttttgctttgctatataactggacactatggtgcctggactgtaaaactcagtggactaatttttcacttatgaaatgaagaccatattttttttcatgggaaaagaagattttgacatgttaaaactggagaagagagttgcatgtactttgaaagtagaaacagattattagtagaagagatttcttcatagataaacacaggtagatattaacaatattacagttttttgctttgatgaatgatctttgcatattctttttattttttttatataggcaagtttagcttcttaagagtagtatcttagttaacagaacatggtagacatctgataaatatctgttgaataagaggcatttttatttttatataatatgtaaacttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcctctttttagctcaaaatcctgattttataaacatacatctgtgactgctaatttcttcactgtaatggaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcactgttcatttctattacaataatatcttacaactgtacaatattagaacattactactaaataatgaacattgtcattacatcatacgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatatcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttcaaggattctaactctgaatcccttcttgactcccaggggctcaatagaggtcacagtgatattggctctttcatagctagaaagcttctctgcagaagaaattaggataggaaaaaagggctaaccaccaaagtcttcatattagtcttctctagatggttgtctaagttgttctctgggccagcagaataatcatcactgctagcttattagaaatgaaaattgtcagtttttatccaagacttgcagcattagaacctctgggagcagagcccagctctctttgtgttagtagccctatagattattctgatccatgctcaagtttgcgaaacactgcctgaggtcagttctgaaacaatagctgatgttgcctgtgtccatttatcttattttattcttagttcttatatagagaggatgcttttgacctatggttttcttagatttgacctctggttcagtatcactatgactatattttggtttctacttttcctttttttttttttttggatcttctgaccctgattctgtaattttctagccctgtgtctcagatgtactttacactggtggtgtaaactccaaacatacagttgtttggaatgatataaaaggaatggtgcattgtgattcagcatttgattgaggaggcctctggaagacattctgtattgaaggaatcaaagagacagttaaaagaaggtgctttacattcatttcaaagaccagagcagcctgacaatttctaagtggtagtatacttgcagtatccataagtaaaaatttaatagattgactttttcccctacatcccttctttttaaatttcttgtgtacatttgggaatagttaaaattgaatggatgaaaacacaaaattgtacatttaaagttttttagaagagttcatattgggactcataatggttcatggatggactaataaatatggatgtagaattattataaatactggctgacatttatataaaaataattgggagttaattgggagctacatttttacataatggtccattaggttaattatgcagtactatcgttcctcagtatactcaggggatttgttccagcccctctaccccaataccaaaatccagagcatactcaagtcccatggctggcctgtggaacgtgcatgtacaaaaagttggccctccatatatgtgcctttcataggccatgaatggtatattttccacccacatttagttgaaaaaaatttgcgtataagtggacccctccagttcaaactgtgttgttcaaaggttaactgtaatcttaaccaaatggaacatagtcaagtataagtaaggatacaaaaagaggtaagtgaatgccaaagctgggctttttccctaaagttatcttccaggtcctggacacattgatcttctgctttgatgattctatagggcactgaggatgggagataaagtacagagctcactttaggtagagactttgctaggagcccttgattaaagcctgtgggaccacatctgcagtgtgaggtgcaaactttggaatagtctaaggtaatatttacaaaatctatgcatttaagaccttgtattttatttatggaatggtatcttaaacacataaatacatttatgaattatgtaattccataaagttagatatgttaagttatgctaatataaggcctcaagtaatatggaaatttatttatctctaatataaatgtctaagttggcagtccagggctagtgtgatagttcctcagtcatcaaggtaccgggcctcttctctctggttactgtgctgtcttcaacatgtagttttcagttcctggtcctaggtagctgcaccagctcccaatgccacatatgtatttcagctaccaggaagggaggaggaggaaaggaaggtattctccttctctttaaagaataacttgaagattgcacacattaaatttcgcttcccacgggtcacatctaatcatatggccatgaccacacctaaccacagaagaggctgagaaagctagtctttggcttaagtgcctaactaaaaatgttattattacacaatgacaggaaatggatattgagggacaactaccagtctctaccacaattacttgcatggtttccaaaagaagctataaattttaaggagggaagagatctgtttgaaataattcagctgtttaccctttgactcatagtccacttctaggaatccattttggagatacattggcaaaaatttgaagaaaatgttactggtcattgcagtgccctttaaacgaacaagaactggaaacaacacatttgcccatcactagaggattttaggttagttgaataagctaagctccatccatctgatgggttacactgcattgtttaaaggaaggagacagatctctttatattgtggtaatagtcagggtttgattggagaccaaaactagaagaagcaaaactgaaagatataagaaatatattctaagcatctgaccatttgcagctgtaaaaactagttaaacagtttaagaaagattgttgcttctgtgtttgatgctataacctgaagtccacggggaagactgtgaggaaaggaagatggaaataaagtaggggggaacaagaacaaaatagaacttgctacagtggattggaacttaggtccatctctcaccacctccaaggcttagtgtaggaaaaacgttggctgctaggagaccgggtaggcggctgtttgaatagcctgtttatatgatatcatggagaaggcctggattagcagaaggaaatgggttagaaatttttttagattatatgaaatatttggtgtctaaatgaatttaaggaggggaaaggagaaggaggtgttaagagtaagtgtagaataagattttcttttctggtattaatggaggaatagtagattagataacctgaaataaatggtgtgtgattgtgtgtgtgctgattttaaatatatactgagctggcatgaaaattagaacgctgcagagttcaaaagcaaagtggagctcagaattctgggaggtaagtgaatgccaaagctggctttttccttatagtcatcttccaggtcctggacacatttaacttttctttgatgattccatgggggcactgaggacaggagataaagtacagagctcactttaggtagagactttgctaggagcccttgattaaagcctgtgggacccattcacagtgtgaggtgcaaaggtggcaggatggaaacttacctgtcttgctctatcctcttggagaagaaaaaaaaaatctcttctgagagtttttatcacaagatgaaccttacacaggattacaatttgagtatgtgctagtagtgcggtctgaaagcacttaagcagataattaaaagtgattctgtgtggatggtgtccatgaaaactgttggaaggaaacaaaatcctctctggagtcacttcaacttaggttagcaacaacccagatactcccacagataaagctccgagtaaaagatagaatccctttgagcggaaacaagaaaaggaagctataaacccatgtagactttaaatattaaaactattttataagaaatgcaaaatgaaggccacgtgtggtagctcatgcctgtgatcctagcactttgggaggctgaggtgggaggatcgcttgagcccaggagtttgagaccagcctgggcaatatggtaaaaccctgtctctacacaaaaaatgcaaaatgtagccaggtgtcatggcatgcgcctgtggtcctagctacttggaaagctgaggtgggaggatcacctgcgcctggggaggctgaggctgcagtgagccatggtggcaccactgcattctagcctggatgacagtgagaccttgtctcaaaaaaaaaaaaaaaaaaaaaaaaaaaaaagcaaaacatgggtttcatattaaaaaaaaggagacacttgagaatacaagaaggtgacaagcaaagttgaagaaaaacaacagaaggtttaaaaagaaaaatataataaaaatctccaatggtttaagcccagaaatttataaacagataacgggggaattgataaactggaagataaaaccaaagcaataaccagaatataatctagagagataaagagaaaggaaagagaggttgaatgtagagggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttaggaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgtcattattgccattttatagatgaggaacctaaggattagggaaattagacaacttgcccaaagtcacacaaccaggattgggcatgtttggcacagatggtgacttttaagaaacttgctcaagctcacagaaataatgagcgatggatttaagttttaaaccaagacattttgacaccagaggctgccgtctttctaatactaccctattttgcatcccacctaattattattgaatggaggacataaatgaaatataacttcctccagtgtcctagtttcatgtcaggaaatagctgtctagtttttaaaagtttcccacataattaaaatgatcttattttttattttttcgagacagggtctccctctgttacccaggatggagtgcagttgtgtgatcacagctcatggcatcctcaagctcctgggctcaggtgattctcccatctcagcctttgaagcagctgggaccacaggcatgtgccaccatgccttgctaattttcgtatttctcaatttttttgagtttttgagaaactcaatttttgagtttctccatgttgcccaggctgataaaatgatctactttttaactgaatggaaatatatacagttggcgctttttatctgtgggttccagagccataagtttaaccaaccatagattgaaaatatttgaaaaaataattacactgaacatgtacaggccttttttcttgtcattattctctaaacaatacagtatagcagccatttacatagaatttacattgtattaggcattataagtaatctagatatgattttaaggataagggaggttgtgcataggttctatgcaaatcctgtgccatttagatcagggttctgagcagctatggatttttgtatcttcaagaagtcctgaaccaaacccccatgcataccaagggatgactgcactattcatagccatgacttaaggtagtacatccctatgtagtatatagtccaaggtttgaatatatatatattgcattaatttctccattggcataggattaatttgcttctttgaaagttataaaaactacatgtcacagtctggtctggttacaggtagggggtttgggaacctttgcaccttgtaatcattagtcattaagggacctagtcatatgtccccagatagaggcaaaggcagctgggaaatgtagtcttcctgcatttgggcaagaagagatgaggtcgtttggcccctgtgcagcattgtgccagtcacagttcctgttgatctctctgactccatcatttctgggcctgatctctctgactccatcatttctgggcctgtgctcataaactgctctctgtgcaaacctctgggctgtggtgactctcccacatgtccagcctttagaaatgatttctttcaattcaaccattaactttataaatcgtacagatgaaaataagtcatatattctttatgcagcaattttcttgaattttatttctccttattttgaatatgcaatcaatatatataaaactttaggtttcctgaacatagaaggagaaagtaacctaataatattttcgatttcctgattatttattgtaattatgacatttgagtgcaatgaatctttttagaaatggagaaggatgtttagaaaaggtagataaggcagaaaaatccagctggtgtaaaaaatgtacaaaatagtgatgattcaaaaagagtgagtcagtgtgacattatcacatataggcatcttgtgaagaagatattctttaatgtcttttggttttacttaattgaatgacacatgacatcagtgatattgaattaaatatgattttcatctgtgattcttctagtgggaaatcaagacagactaaaagactaaaatccttgtattgtttgtcttgtttctaggatttctggataatccaaaaatacgtaaaaataggacataatgatattgaggaacttttttagcagatgtactaattgtgtatgaattcatatattttgaagagacgaacattatttaaagtagctttttaatggtagaagacttaaaatattttttgccaagtatcagtgtacgtaaagagagaaattaatattttgtattttacattaagcagattaatttgtgcgggttagtatatttaatgctaggtacactcacaagagtaagttggatccattagtgggagaaattgaattcatttgttagatttttaaattagtttctaaattgaaataatacacataatttaaaaagtcaaatgatagcttctaataaaaaatagcagttccttaccttacccttcaccaaatccaagcatctttccccacaggcaacaactttcaactcttttagttgaaagagttgaactccagactttaagaaatgcattttatttataaatcatccagtcttaggtattctgtcctagcaaaacgaagtggactaagacaattaggtttgctaaatgtcagctggatccttaactacagtgaggtagttctgataccctcttgagtttatttaatttcttctttttaaattaaaaatgtatacaactgctgaaaatcagataattttattttgttgtacacaatattataattaaggcattggtttacaatggcttaccttattttcttaaaaatatttatttttctcattataaaggtaacacatactctgactgtcagccatcgatgcttaacaggccactcctgaaactcagtggctaagtcaacaatgttctttatatagctcatctgcaggtcagcatttaggccggtcacagctcagcaattctggtcttgtctaggcttcctcataggtctatagtcagttgtaggtcaggtgtgggttggatttgctgattttagttgggctatttcaccagttgtggctgataggctttggtctatctgtccctttatcaccctgcgggctggctcaagcttgttcacctggtggaagcagaggttgtaaggcccttgaagcataggcttggagttgacatactgtcacttctgccatagtatgttggccaaaataagtcacaaagtcagcccaagttgaagaggaggacaaatagacaccatctcttcatgggaaaagatgcctactcatattgcagaagggtgtgaatacagggagatttggattctgtctattgcttaatcttttatatatgtttgtactgaaaagtacaaacaaagataaaaggaactcataagtccatcctctaactactgttgactttttgttttatatactgtaagactgttttatctatacttttaaacgtatattattaatttatttcagtttccatttgattacaagtcatgtttgtttatttcatatttcttctatgaagtggtcaagtagatttctattttgttcttaaaatcgcatggtagcatttcttgtaaatctacagttccagatatctaaagccggcaggacttcagctaataggcaattattctattttgtgatgagaaggccctgacttagtattgagtagcaggaagaatcaaaaggtgttcagtcaactgacagtgcaattgcctttgaatttgtttgtatatcttctgtgactgagttaataaactgaactattcatggaataggacccagtgggattttcttatgctatggtatatttttaatattattcacttttcaggctaagtttgaccgtaagcagatatctatttttgatcattagctttaaggtatttacattctcaatgactaagcttaagctatgtggtagagtgatttatttttgttcctgaataaaattttaataccatgagtcatgtgttttctttgtaaaaagttccagcatcacagaactatatagcataatatagtgaaagttcccttttcctactggctcactttgaactcctttccttaagcctttttctgtgcttttatatttacatacatatgtgaatatatagaatacatttacttccatgtaaacagattttgtatgtgtaacataaaaatattgtattataaacattgttttgtaacttgctttgcaaattattttctatccatttagtcaagtatgtgagtgtataaaatgtacacacacaaataatacaaataagagcatgttacaaatattgtataacttgctttttttaccaatatatttttgatatatttctgtatctattcacataggcttagctggtttttatattcataaaaccgtattcattttatagtcataaaatttcttcacatgtaccttcacatgtatcctttccctattatggaacaacgaattgtttctaaattctggttattttaaaaaatgttgaagaaaacatctctgcttgtatatatatgtgtatgtagaagaagaaaattacgcttgtgttctttattgtaaatattctacaacctgtatctcttaatccctttcttgctttctctaagccccatatattcaatttagccctgagtaatgcatgattgacgaagccagatgctgtgtgtctaaacagcagttaatgaaaaactatggaaggatagggaatcattaccacaggtactgtggggcggcaagactcaataaagtaactgttactaaaatctaaaaatgaaaacaggaaatatttgtcagacatttaacttggcaattgtaagagtgaaaaccttgtgtttttattcacttgtgtatcagaatttgccgttttttaattaagagttattttttaagagcaattttagattcacagcaaaattgagagatagacatggagattttccacatacccactgacctcaaacaagcatagccttccccattgccaacatccccatcagagttgtacattttttacaattgatgacctatgttaacacattgtcatcactcaaagtccatggtttacatcagtgttcactcttagtgttgtaccttctgtgggttgtatgatgacatgtatctaccactataatatcttgcagagtatttccactgtcctagaaattttctgtgcttcatctgtttgtctcccctcacttcaacccctggcaaacactgatagctttattgtatccatagttttatcttttccagaatgtcatataattggaattatgcagtatgaaaccttttcagattggcttccttcacttagtactatgtatttaagattcctccatgtcttttcatggcttgataactcatttctatttaatgctgaataatactccattgtttggaagtaacacagtttatttattcattcacctgcagaaaggtatcttggttgcttctaagttttgacagttatgaataaagttgctgtaaacatccatgtgcaggttttggtgtgcaaataagtttcaacttattcatctggtagtaattgttttataaatttgggagctccagtgttagatgcatattatttaggattgtgatattttcctgttggagtagtccttttatcattatgtaatatccccctttgactttttaaattgttgttgctttaaagtctgttttgtctgagaatacctactcctgctagctttggtttccatttgcatgaaatatctttctccatccctttaccttaagtttatgtgagtccttaggtgttaagtgagtctcttgaagacagacagtagatacttggttggtagatttttatttattctgtatctcttaagtggagcgtttaagccatatacatttaacattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttatttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaactttcagatttttcttcttcctcaggaacaccaattattcttaggtttggtcgtttaacataatcccaaatttcttggaggctttgttcatttttctttgtctttcggttaatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgaatctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatgtctgcaaagagtcctgtgaggtgatatgtcttcatatctcctagctgtggatgccagcacctgctccagtataggtggcaagggagttaagtgtactctatgatagtccttggttgtcgttttgtttagtgtgctggttttttcgaatgctggttatgccagcagtgaagttgttatgtggacagacttagaacctctggttagtcaggatgttgtagatggtagaattagctgttttctccttttttggagcagggttattctgttatgtcttgagttggttggcctctacccaggaggtggtgcttttaaaagagtgccagctgtggtagtagaagggggatacaagtttgttctttgttggccaggatgagtacttgggttcttcaggcaatggatggggctttagagttctcaagggtttatgtattttggctcaggctaccagggtgggtagtgaaaaaccatgaggtgggggcaggcctaggcaggtctgagctcagactctccttgagcagggcttgccgaggccactgtgggtgatgttccggggcattacagctgcctctgctgtgtcatactggtcgccagggaaggggggaaagccggcagtgacaggcctcacctagcttccacgcagccagcaaggccaatctcactcctgccatgccccaccaacagcacacgtttatattcaggcagctggggagagcggatagatcttgccccagactacaagccttcctgctgagaaaacaagcagggctctcaggccttgcccttttccgtctgcctgcaccatcagctgtggcttctgtgcttgtatctgcaagttatatgtgcacttcccatttgccccctggactctgctcaggaaaatttgtactcagttgaacgtattatgaagttcagctagaagcttctttcatcctatggcccctccctaattccactggctgccttccccaaggacccctgtgagataagtcagggatggctttctctggtttgagccgggaactgggagtgcctacagggcgcttcccgctccttcttctactttgatatttcacttggctgcctaaatccattttaacttcagatgagattaaattcttctcctgtgatctggatttttaggttccccagtggggatgtctgttcagaggcagacttttcccccactcacactttgggaacttacagtttttcagctgtctcatggagtttgcagtgtcaagctacttctttcaaagtaagtagcctgtgaattcttttggttttcctggtaggttcctgtggtggttcttggaggaaaagtttacagtgtgagtctccacacactgttctgtctgtccaaatgggagctacatgttagtcctgtcttgtatctaccattttctccatgttggtaatttagatctttgtatttcctctagcttttaaaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacacatgcacgtttatgttcactgcagcactattcacaatagcaaagacgtaaaatcaacctaaatgcccatcaatgatagactgggtaaagaaaatgtagtatatatacaccatggaaaactctacaggcataaaaaagaatgagatatgtcctttgcaggacatatctggaggccattatccatagcaaaacattatccactatagctggaggccattatccttagcaaactaacacatgaacacaaaaccaaataccacatgttctcacttataagtggaaggtaaacattgagtacacacagaaaagagaacaacagacactggggatctacctgagggtggagggtggaaggagggtgaggatcagaataatacctatcactgaggttggtggatcgcttgagccaagggtttgagaccagcctgggcaacatggtgagacccccgtctctacaaaaaaaatacaaaatttagccaggtgtggtggtgtactcccatagtgccagattcttgcgaggttgagatgggaagatcactcgagcctgggaggtggaggttgcaagtgagccgagattgcaccactgcactccagcctgggcgatagggtgacaccctgtcttaaaaaaccctccaaaaccccaaaacccaaaaaacaaactaccaatcgcttactatgcttattacctgggtgatgaaataatttgtataccaagcccccctgacatgcaatttacctatatggcaaacctgcacatgtacccttgaacataaaataaaaataaaaataaaaaaaggttttctgaaaagagaggaattgtttttgcagtttagtagccattgatggggtggttcagatttagcaagagaggtggatagaaacagttgctgggtctgtggtcatatgagggccactgtggtacatttttagtctttctgagactcttacagattatttagaattatttacaacatattctaacatatttgggagtgtattttatcattttaaatcaagccataatcttccactttttgactacaggccattcctaatgtgtttctcagaatgtgtgcaaagtcaaatatctggaagtcaaatatttacttacatttaataaatagatttctttaccaagagagctaaaataaaattctatttaaacttcaccttttatacacggttgtcagtaatatagtttccaacattttatatatacctttaatttttttctttttgaattgatcagttcaagtgacttaaatgcactgagcatccagctgaggttaaaaatttactgtgtgcaacatagcaaataatttctcacttgacccttacttattctctttggtgataagagtgttttcacttttctgttttttacttataaagtattaagggcaaataagaattctaataatatagaaacattgctatacaggcagtgacattaacaatgcccaaactgaacacttgactagcagaaagggtgttgagcttccattcttacagctagcttatcttcagaatttcaaatttagaataaaaggcatataataagccctttaggagttttcatctacactatatatataactgtgtgttgagcataagttgaaaatatgaaaatttaggtctgcccatacttagaggcagataggtagaaaacactaaactcttaaggccattaggtatttagtaatttttatgtacagttactttttaaagctagaaataaagttgtaggcttataaaaattacagttgagaaaattttctcagtaatatatattttagaacatttattaattttattaataccctttcagcatctctcagtgttgaacttgaatttatgaattctagctaatttatatatctttagcactgaatatagctagggtatgaagtgattaatattggactacaaataatagtttctggctatgtaaataaacttggagttcttcattttttgtagtattaatgcatgatttaatatgaaggaatttatgttcaagaaaaatacagatttctaatggaggagtgatatatagtaatgcactgaggcagatggtggatgataagtatgtatagatcacacctgctttatggaatgtaaagcttgattcgtgtgtaaaaaattaatttgagaaaatggtagggaatggctgggagtctgtgagagaattctagatttaacactttgattagtctcaggaaaaacagccattatataatcttaggttatattttctatttttaaacaaatatggcaagcataacacctccctttttaaaatacacagtttttgcaatttttcaagacttagggaaaggatcaagcttgatatatgtttatatttaatacttctgaaacccattttgggcagatttctatctactataacagtggttatgagcttggaccgctgagtggccacactatctataaccgagttctttaatatgtctttgcctgttttctcatctgtagcattgggataaatctagtagcagtcacattgagttgtaaggataaaaggtgatactttaaaggtgcttaaacgtgcctaatatgttgaaagggctcactaaatattagcttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgaccgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttagatatgcaataaggaattttgcagtctaataaatatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttccccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaattactgagctagcttgagagcttagcatcaatctttcaattttttaatgaattcatttaaaaaagtgctgcatcactgatgtgcttggtgacacagaaaatgagattctctggagaaatgtggacactgatatatgtcaaagagtgagggagaagaattacatttggatttcttcatgaattttaggaattgattaaaccaacttattttgcttatgttttgtttttatgtctgtgtcagtgtgatagataataaaaacccatatctaattaagtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgtgagacttaccagttaattaattattgaagaaaaaaattagactgcatttgagtttaagtgggtccaagactttctgtttcaagttaatattgctgttcatttaaaaataacaggtgatttttttttaattttcagtgttactcagtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggagaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaagataaggaggtcataaatagaataccaaatgtggttttgcttcttttacagttagagagctttgttaatatcctcattttcttcatttgtactagcatttccaaacagaatttgtttcacaaggaagtatcaatgtatagtgtctctgtcaggccttgcattaagcccagtttctcatagtcggttttcaatgacatttctaatttggtatactttctgttatatcacaacttattttcccagccatctaagggagacttgttaaggtgggtcaacctcatttttgtttttgattttaatattaaaaattttgttaaaatttttatttcgaaatagttcaaacaaaaagattgcaaaaatagtatgaagaattcatatgtacctttcactcagcattcccccatgttaacctcatacataaccacggtaatattgatcaataccaggacattagcatggatacaatactattaactgctctgttcacttaattccaatttcgttaattgccccactaatgtcctttctttggactgagattctatccagagtctatttatcgttctttctccttagtttcctttattctggggaagacagttcctttgtcttttttgtctgtcatggtcgccacatttggtcagctcttttgtagactgctcctcaaattggatttgtctgatgtttcctcatgattaaactcaagttatgtctttttggcaagaatattatagaagtgatacaagtgacagagtgtccatttcagtgcatcatatgagatgatgtttacttgtttttactcttctgttatgaatatgtaccccactgctaagaatgccagcttttagcctttgtgcagctaattatatttatttttcaagatttgcctttttaaaatggttttctttatttgctgcacttcatttgatctctcacttctttgccttccttttgccataatactcagtaaaaccttgtcatgcttatggcttgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttagtctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttgattatcagttttatacagaaaataatagtgaaaagaataactctttttttagccttaatgactctgtcattgaattacttcaaattgtgatgatattttcttcctaagagctgattaatttaatgtgttcacactttgttccaataatggtcctaagattacaggtggaatactgggacacaaaaataacacaatattttgtcagagatgaccaaactcattagatacagagacaaagccagaattgggtttctggttgggtagatttacgcccctcctacctttccccattagactgaattttaacaaaccagacaggctttctcaggtatggagacttcaaatatgctgctgtaatcagacagcatgagctaacatattttaggaatatacttgacttcattttaaatagagaacatttatgttttctcactatttcatgtgtaatgcaatatgaataaagccctatccgagtttcatgtttgtggggaaactagcattactgcagattagtgacagggcagagaaatgaccttattatctctgtaatggtaatagtgtgcttcacagggaaacttgtgttgttaagagtgagttgttattttgttgcagatgctttctgcacaagttattaatatattgaatcagaaggattggaaagtgctatctagggacttaggaatataatttataagtttcagtattcacctttacttgaaatatgtaaatctgattttgtagatgtatacacaagcataaacatggtttcacgcttgtgtataccttttctttctttatggaatatactctctatttttcttgtgtcaagtacctctgtctctaagacccacagcagttgtatcctccgtgatgaaacctatccctgtaaccgagttgttgcttccctttagattcccagagcaatttgttcccattgctatattatgattttatttgttggcttataaatctatttccatctttgtaactcacagttgagcgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaattattgtctattttgggatttatctaaaaaagtagttttatagattttactgttttttatttaaacatattaatcatttaaatgatattaagctctcactgacactgattatataaatgtcattggattggaaatctacaaaaaaacaaggaataaaattcaccactctatcacccataaagcacccattacatttaatagtttttacttataaacatgattttaaaaactactttgacatggaaatatggtcaagtatattgatgagtgaaaaaaatgcagattgtagaagagttctgaacagtgtgtacaatgtgattctatttgtgaaaagaaaaaatattatatatgcgtacactaacatacggtaaatatctgaatagatatggaatcagttcttagttttcaagcaaatgaaatcaactctccaatataagcggaagaaatttattgaaggataataaattactcacagatttctggagtccttgagaatcaggtttagaggccatatatctagaagcaataccccaaataactggttctgcaaagaggccctggcaactgtcagtctgaatccttgatactactaagcctagatgccggatttgcctccactgttagcagtattccagaatgaattctagacagttactgctcttctgtgtcatcagcttccaattcagagtctgctgtgggtgcattggattgccagagcccaagttttgtgccctggctgcagaggaaccttagcggggaagaatgtggaactcacttctgtagtggacaaagggccctgcctcctaaggtaggggatttaccaaatgtaggaagaggattcagaatcttggatgccagaaagagtgagagccgtccacagcagactcctgggaaattgttaacattggttacttctggacggtggagttggaagggctaactgggagccttccagagggaggcttttactttaattttattcttctgtcctttttgaatatacatatataataaaaaagtccatggggaaaatgaacaaaagggaacaacagttttttccagcatttccactgatagtattttcgcataagaactcaagaatggctaggcgcgatggctcacgcctgtaatcccagcactttgggagcctcggggggcagatcacctgaggttaggagttcaagatcagcctggacaacatgttgaaaccctgtttctattaaaattacaaaaattagcagagcgtggtggtgcgtgcctgtaatcccagctacttgagagtctgaaaatcacttgaacccaggaggcagaggttgcagtgagctataagattgtgccactccactccagcctgggcgacagagtgagactctgtctcaaaaaaaaaaaaaaaaaaaaaaaaaaggccgggcacatgcctgtaatcccagcattttgggaggccaaggtgggtggatcatttgaggtcaggagttcaagaccagcctggccaacatggtgaaaccccatctctactaaaaatacaaaatttagcctggcagtagtggtgtgcacctgtaatcccagctacttgggaggctgaggcaggagaatcacttgagcctgggaggcagaggttgcagatcacaccactgcactccagcctgggtgacagagtgagaccctgtctcaaaaaaaaaaaaaaaaaaaaaaaaaagaactaaagaaggcttctcagcataactgggcagttttatcaacttcgtactcaattttattttgaaattcagtttataattttctcccagattcagtcatctctatataacttggttgggcagagaagttcataaaatggttttctctcagataccagtggcttccttttggcttggtagagctgatttagtttatctttttgaggtctacagtattcagctttgaaaagtaaggtgttgtcagtgactctgattgatgaagtgttcatagatctaaggtgaaaaaatacaatctactttaaaatttttggccctactattttttccaaacccccataaatttgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtgaaggtgaggtgtctatatatattaaaatgtatatgcatgtggtggccataaatatattacaacaatgtattaattagaaacacatatcttttggaatacatgtatacccatgttactttcgctgcaaatggctataatctttttcatcacatttcctgccatctctcatcattactttgctgctcacgtggacccatccactggtcaagcctcaaaattccatatcttcctttttttccagtgaccctctctgctgatccacttcattttccccccgacttgctgtcactttgctctacctcccaactttttctctggccacgaactcctatctcttctacttttctctctccttcttttacagatatggtcagttttaatttttctgtataaaggaaatccttattttaggaaatttagggcaatgcaatataaagaagataacaaaaatagttttcaatatcacaagctcctactctcctttccttttgatttttggcatggagagctagagtccttatggtttctcaccttcagtggggtaactctgctgcttggcgagttgtatcccattgatattgtccttggtgggtgtggcaaacctttttgctatccttctgtccactttttgatccacatctctgtggtcagctcatgaccttacttctctttttaatagggaggttagagtgtattaggtattaattcagataacttgctcttcctcttgcttctaattctttccttcttccctttgtcttgaagaagaggtgtctggtttacttagcaacctctgcaaatcagtttcagactgcgttccattttaccttctccaggactgtagtctattagctagtccatctctctcctgcatcttcagttttccatttcttgttgctcttatttaaaaagtatgtttctcttcactatttaaagattcctttctccttaaatacgattatgtctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactctgtatatagtcttaatactgtggattacagtctaagggttatgtggagattctggctcctctaatttacagtttctatctaagtagcctcatgacctttggcctgattacattggtcttgtttttactattaagatttacatagccagttccctcttaagaatatagtttagctctcatttacctctttatatccagtatctttcacaccaatgccaagataatttaagaagcatctattttcatattgatacaaagaaggttaagcactctgtttgtaatagtcttatcaattaagtctagctacatgtaaattatatgtacctagtcttaatagataagtacaatagatatatgtacgattaatagatagatgtacaattacatgtaaaattgtaggaaacaatgacatgtattattttttcttgatatactgctatagtatagggcattttatatttaccacttttaagagctttggcattttcatagcttttacaggctctttcttgggttagttacatgaaaataacctgcagatactactgtaaaagtatagcctaggatgtttttaggtgaagagtgttttataatttagtagaagatgtaagatttgttatagtaaatgtttgtgaagactcacttgacaccatctaaacacttgacatgcttacaaatgatcccgagccattctatttgtagttgctgtaattaagagcaatatttcagattgagttattcatagcttcatgaaaataacgctttttgcaggcattttcaaatcaagtcagacaccgggttttctttcaaatagccagacgttccaaattatagttaaactagagttgtcttcttgtttgcaacatatatccaccacttatcctggggtttgtatttttagtgtagatggtgcttttgtatggggatatgatgttttatgatggcgcagtgcggagggcattcacatatggtcagggcaagcacttttagaactttatttacgtatctatctatatatatataaataataccttaaacattcaaaaagcatttgtagcagcttattgtaaagcacaagtatactaatacttcattttggcaaccgtggaagcaaagagagtagagttaggggcagaaagaagggtgaagttgtttatatttacatcgatagcagtttgcttttgcatcactgtgttaaatctgttggtcgcatctttgtctgatcctagaatgcagatccattttccttagggctctatcctactgggaaagatgaaagaggagacaagcgatctctactgaatgagaaagtgatgcatcagacctctgacttattagcgtcattattttgttttgttttgggatgctttcatccggttgtgacagtgaaagccagcttcttgattgctttgggtctatttgagactctcttcgttgctgatgatggtacctctcctgttttcttttgatgtatcaaaagaggtaaaattttgatacttagctttttcctgctaggatttagagatgattttaaagaagagggccctataaccaaatatttatatggaaaatgagggttttttttcccccagagtgaagcttttttaattcatcttgatgaattctatagtaaccaaaatttatattataatctcttttaattagctgtgttttatcagttgtttttgtcttatgactcattagatcgctgagttttattcgttgtgtgtcaactaaaccccaatatatatcttttggaacgcctgatcaagaaaagaaagcatattaaaggcaaaaacgattcgttgaacacacattatcatactctatacactaaaatgcctctgggacacttgaggaattcatacttcttgcttaatccttgatacatggtttggaagttataaaccaaaataaatatttgctcggggatagagaaaggagcagagtctttgactgttgctcaagggagttaaaaaattagagacttaaatggtcctagaaaccacagctagtttttccactcaattctgaacttgatattaaaaagctaagctggagacttctgaaaagcacagtagaaaattcttgagttttgaagtgcttaagagacagagacctaccctgtgccatgggtgtgtgtgtgtgtgtgtgtgtgtgtgtgtgtgtgtgtgtgtgtaggtggattggcttaagagaatcagctgtgtgagttcaaagccctgaaatgagtggcatgttgacaccgatgacctatagctgctttttagttggctacacttgctatttggtctcaaccaggtgtgtagaatccaggtatatagaactcatattttgtggggctgtagtgacaaaattgaaattttgaggggatttaaacacatacttgaccttttatttgccaaattctaaaggtgtgaatggtgaaaggtaagtagaaaatatctggaaagtgaagctatcacttggtaatgaagtgacaaagacccatcatactctcaattgaaagccatggagagttaggtcttacaattagaggcaaaccagatgtagaccaggtcatctcaaacccacaatacagcctctacccctttgaattttttattgaattatgtacttttactctatctgcgcagcagagccaaggagtcaatcctctcattatctggaacttctataaaccagcattcaataaaaaactaagtagatgaagagacaggagtatttgatcaataacaaaggggaaagaaacaataaaaagcagaagcacagctgatccagatattggagttagcagacaagaacatcttgattgttatgcttaggaacatagagaaaataaggaacaaaagaggtaagagggtggagaattaccctagaaagtttgtgtgtgtgtgtgtgtgtgtgtgtgtacatgtatgtatatggatcaagtaaactttgtggagccatcagagaaatatatatctgacaataagaactcaatgaataggcttataacatatcggactcagtagatgatagcaataatgaactggaaggctagttaatagaaaatgtccaaattgaagcacaagtcagaaaagaggataaaacacatttgggatctggtcaaaagatctgtcttatatacaatttgaattccagaaaaagaagagagagaaaatctctaacagtatctaaaaaaaaattctcatgaagatttcagaacatcattacacaagctttgttaacttttaagattatattcaaagaaaaccacacctgtatgcacaatggcataacatcttaaattgctgactgtgctagcctacaattctatattcagtgaaaatatcttttaaaaattaagatgaaataaaaatagtttaggcaaacagatattgagagaatttatcactagcaggctctcactaaaagaaggtactgcaagggagctccctttggcagaaggaaaatgattctaaaagaaaatatggaggagagcatacactatagcttagtattgattatccgaaacagtagtcataattttctgtgaaagtttaagtttagtgaagtttaagttaaatatatggaattgaaatgtaagacaataaaaacacaaaagctagggggtcttacatggagttaaaatattctgttgttctaggattattatgaagtgtaatgttctggttaggttataatcaaggatacaagttataatctccagtgtaacaactgaaataacagggaatgaatgcatatctagcaagttaataagagaactataaattaataaaaatatttggttaatccaaaataaataagtatgaaaaatggatgggtcaatagataacagatgataagatgatataaacccaaatatagaagtaattaaattaaatacaaaaagattaaataaacctagtaaaagtctaagatcctcagacttcatgaaaaacaactaccaccaccatgtgtagcttaaaaaaggcatactttaaatataaggacatcaaaatgttgaaaatgaaaggatggaaaaagaaagctggtgtagatacactaatttcaaataaagcattaaggcaaaaaggactactagaagtgaaaaggagcatttcattatgccaaagggaccagtccaccttaaatatatcataatcctaagtctatttcatccttaataacatagtttgaaaataaataaagccataaactaaacaaagaaaacacagaactcagaagaggtatgaacatattcacagttacagcaggagactttaagacatccctcttaaatcttgcttaatcaagcagacaaaatctcgtgaagtgtatagaagatctgaacaaagcaatttgtaaagttgtcctaattgtgcaccaaactatcaatagaatatgtagcatttgtcaaaattggccaaatgctggggcataaatataaccttaaaaaattccaaaagcttggagtcattgagattatgttctctaacaatagtggaattcagttagaaatcaagtgaaagaaaaggacaactagaaaagcctcgacttcctacaaattaagtaccttactctaaataaccgtggattacagaagaaactcaaaaattagaaaagaaactggactgaatgttaatgaagatagaatatatcaaaagtttcaagaaccagcttaagccatgctcagaggaaactttatagctgtaaatatataaatttaggaaataggaataagaattaaaaaaattaatgatctgaatttccatctccagaaagaaaatcaaacctagagaaagtagaagaaatgaagtaattaagagcagaaattactgaaattgaatctgtagagaaatttaataaagtaaaatttagatctttgaagagattaatgtaattgataaacttttaactaatggaaaaaatagggtagaaacaaaggacaaatatttgtttgtatgatgaagagcccacagacaatggtaagacaaagaggatgttatgaataattttacaaataagttttgagtaaagttgacaattttctggaaaaatataagtcattcaacattgatacaagaggaattagaaaatctgaatagtcatgatctattaaaaaattaaatttaatgttattaactctcatacagagaaaaccccaggcctaaatggctttattggtgaattctctaaaatgtagtccttatgcaaacccttacggagagtggaatcaaagagaaaactttcaaattctttttataaggccagcataatcttaatatcaaacgtatttaggacagtataagaaaggaaaattatagacagcttttaaaataaatgtagagcacataatgttcataaatattcacaaagcagttgatacaattcctcatgttaacagaaaacaggaagaaaaacctgactaccttggtagtgcaagagaagtatttattaaaattcaatatttattcatgattaaaatttcatagcaacctagaaatggaagataattatcttactctggtgaagattagttgcaaaatgcctgcagcaaaaattataattcctagtgaaattttgacagctttcctcttgatattaggactgtctagggaaaaatttcgtgatacgtatgtcagaactttacacagaaaatcacagaatattatttaggaaaattaaaggcccataaactgaagcatatagcatgttagtggattgtaaggccaagaagagccagagcaatcttgaagaagaacaaaactggaggacttaattatcaaatgttgagatgtgttattagtgctgtagtaattataacattatataggtataaaaatacacaaatagaccaatggaataaaataagagtctagaaacagacctgctggttatctgattcaggacaaaggtgactttgcaattttgagaggaagaggtagttttctcaatagaggatgttgattcatttgggtactatgaaaaataattatattaactcttaccacacaagcatcagttacagctgagttgcagatctaattgtgaaaggaaaaaataatgctcttgggagaaagcataggtgaatatgttcatgtgatcttgtgcactaataaaacactaacgttaaaaaagggctgataacattgtgcttcattacatttaagaaaatttattcatcaaaagggtgccaataagagagtaaacaggtaattacagatttggagaaactcaaggaaacttatatctggaaatataaagtacttacacaatcaaaaagaaaagaccaatatccaatagaaatatgggtaacagtcttgaaaaggtacactaagtgttggcaataatgtggagcaattcaactctcatagactattgttggtaacataaatttgtacaaccattttggaaaattgtttggcagtatctacctgaaccctataacctagcaattccaatcctgtatgtgtatatgtgaagaaatatacaaaaaaaaaaaaaaaaaaaccagaagcgttcataggaacattacttctagtagccccacactgtaaactgccgaagtactcatcaactagagaatggatcaataataagtataatattgttcagcgatgagaataaatgaactaaaaatgtaatggaataatgtatattcatctcataaacacaaagaagccagactcaagtaagtacatactgaatgatttattttatatagaggtaaaaaatagacaaaactaattgatgatgttagaagtcaggctagtgattatcatgagagtggttaataattggaagagtgtgtaagggctatgagttgctggtaacagtttcttgttctgagtgctgattattcaggttaaatttttgaaaactgagccgaacactcatttggtgcaccttttttgtatatatgttaaacttgaacaaaatttttaaaaaagaaataaaaagaagcactatcttctgtttaattcatttcctttacttcacattgtagtgagcccttttatggactcagggagagagagccttggtgtccttagccaggaagattttccttttatcatgcagctctgtccacacccttcgttcagtttctccctgcaactcagctcagctgtcatgctgatgtgaaacaggagctcataagtagggctgttctctctcaagccttcccaggagtaagaacagtggttagggttatgggctttaatggactttcctgctgacatgcagaccacattcaaaatgagttaaaaagtgagctgccgtgttaacaaaacagtggccaggccgaatagctgttgaggtgctgtcaagcttgaaaggaagatttttcttaaataaggagaaattcagagaaggtgccttcaaaaataagaacttgattttggcaggagaataaacaaaaggctttgaaagaaactcagattctcaagcatcgttgtcatttaatctagaatcaactacataacaacactgcaaaaaaagaactgaagcacaatcatttacaaggtctaggtgattttcacatatctatagagaagaaaaaactgacacttataattctgacatgtttaaactttacctgaagattaaattatgctaattattaaaatgtataagaatttgcctttataccgtacagtctttttaatttatctttttctggtgtgtcctgcctcccagattaaattccaaagcatatcctgctggctttgcctacataatatgtccaaaatctgaccactgcttgatcctgctgcagactactagcatttctctcctgggttttggccatagccacctaacaactgtcttgcgcttctgacctttccttgccataggcagagttgatacttttaatctgagtcatatcatgttccttctagtttcaaaaagcctcagtgatttcccattgagagagaagtcaaattccttaccatggcctacaagaatttacctgatttcatcgctttccacctcctaccacccatccaccctttagaaaatgttctttctccagcaagccccttcattcactctgttattctatcaggggaacctgcccccaacatttcaacatagattctttctattttccataagtgttggctggctgagaaataaagagaaagagtacaaagagaggacttttacagctgggccaccgggggtgacatcacatatcagtaggactgtgatgcccacctgagcctcaaatcagcaagttttttatttattaagggcttcaaaaggggagggggtgtaaaacagggagtagatacaaagatcacatgcttcaaaaggcaaaaagcagaactactaataagggtctaacaaagagcacatgcttctgagggaacaggacaaagggaaaaagcagaaccactgacaagggtccaacaaagatcacaaggcaaagggcaaaagcagaactactgataagggtctatgttcagcagtgcacctgttgtcttgataagcatcttaaacaacagaaaacggggttcaagagcagagaaccggtctgaccacaaatttaccagggcggagtttttccccaccctgataagcctgagggtactgcaggagaccagggcgtatctcagtccttatctcaactgcataagacagacattcccagagtggctgttttagaccttcccccaggaatgcattcctttcccagggtattaatattaatattccttaaaagaatttagcgatatctctcctacttgcatgtccatttataggctctctgcaagaagaaaaatgtggctctttttgcccgaccccgcaggtggtcagaccttatggttgtcttcccttgttccctaaaaatcactgttattctgttccttttcaggtgccctgatttcatattgttcaaacacacatgttttacaatcaatttatacagttaacataattatcagagtggtcctgaggtgacatatatcctcagtttacgaagataacaggattaagagattaaagtaaagacaggtgtaagaaattataaaagtattatttgggaactgataaatgtccatgaaatcttcacaatttatgttcctgtgccacagctccagctggcccctccattcgggttccctgacttcctgcaacatcattctgttaggcactactcaaataccattaaggccttccttgaccagcttatgtgatactgaatcctatcaagacttcctttcaccttttccttctttcctcttctctgtagtgattagcatgagctaaaatgttacgtactcttgttatttacattgttgatctttcttccaagttctgtgacagcagaaatttttgtcttttggttcaaaaattcccagtacctgcaacaatgactgtgataggattggtgctcaataaatacttgctgaaaagtaataaatattagcaagagaaagtttaacaatgctatgaaaactgttgtaatattaaaatgttttcaatttggtgcttcttcttggtgctcataaaaaagtttaaaaagtaactttagaacagtattctatgaataaatacattagtttattctaaattgaaatatttatttaaaagttttaagttttgctttgaccttgcatttgacttttcttaatggttgtctatgtttcataatggcatatagaaattatttatttgaattcttattagaataggaacaatttatctactttgaaaggcaaagtgaaattgactgtacagtaaacttcagttattcttaatttctaagacatgagttttatggataattacattttctgaatagatgggagttactatttgtatagcagcttttaaaactgggtctgtcctgaatttcgtagccatcacagccactgtgcactgctttagatgagggttcttctctgttcaaatacaccctgttacaagatactgtctcccagtcttccctccccctcactctctgcccaaagcaatctcctacctttttgaagttcttgggaagtgtttttttttgtttttttttttttaattttaacaaaattagaaaatgatagagaaaatatcttcatttctgttccctccatttttctctccagctctttttcctgctttccctttcttttctcttttaaacataggttatgtagtagaagatgaagacatactcatagaaatgaatagttgttctttgggtacatattgggcatctctagtctcaagatattttaggggtagtctatcataggagcaggataaggccttaggggaaaggagctagaagtaattcagctgtggcatgagggagtgacagtagctgggagggagggctcagtgttcttagatttagcattctttcctcccatcctttcaccccaattatttccattcttgctatagaagacttcactgggggaactggataatagcaggacaggcactaaggctggcagagttagtgggaatggagacgatcagggagcagaggtcttcagcaaaaaaggaaagggaaattgtagagctggaatggggaaggagtcaaaccttagtaattggatgaaggaccaagtttgtttactctttgcatttgcacctgggtgttaatcaccaagtatttgtgaatggtgcagaagatgttctgaagacccatagattaaattggaaatttaattctgatttgttagactgaatagctttaaactggttttatggagaagttgaagaatttgtctatagagaatctctaatatttaagtattgccagttaaaatatacattttaaaaattggttacttgaacttaagtgaataattccgtgactgaatactagctattttgtttgaggctgtgtctgtttgaggggagcagagggggacagaaagtgagttaatgaaatcaagaacattctcaaacagttgaggggttgggatggaaagggagctagtaactacctataaccactagaggcctctcttaggccaagtttcatggttaataccactaggtttccacagcggggcctggctctgccattgtaaattaaacatatgttataattctgaataaatagtatgacagtagttttattctagggcattattataatgtaacctaaatggtttagcttatatatcagaataactgatgatctcgtgaattgaaaacaacaaattagaattattttctctcttctttttctctaaacctttagttaaaaatgtaatcaaagactattgctaggtaaaattatatgtcttcttgaccgtacaaggatatatgggtttaaaattattcttgttacatgttgtgtttaattgttgagagtagtttatatttctgagggtagactataataaagtcattttaagtcatatgttaaaaattatgtgtatttctttcatgcttataataagcctctaatataaaaaaaaactaagaaatgattcaaagatctgttagacttaaatgcttttccttaggcatagggaaaaatggtctcattttgtgtgagtttggaattattttggatatggtttgaccttgcagagaaaacaggtagggcggtgccctcctctcagatgagaatagtttgtttctctgttccaaaacaggatggctgacaatttgaaagttggtccctcctgccaagtcattcttcctgtaggattttctttgtcatgatcacaactagttagttgttgtactaattggaacaagttctaggctgttggatgctatattgggatgtggctactacattgattgtcctgcctgacagcccttggccacttcctttaagtcccatgagggcagggaattttgtgtattatgttcattgctatatctgcaagagtcctgaagagtttagaatatagtagatgctcagtaaatatttgttgaaccatctgaaaaataacgtggcatttggtttttcagtgaaagaaattaaagaactggtaaatcctctaggaagaaaatacactgagattatcagtcatgccatggggtctatttttattatgatttacattttaggtacattttaaagaagattaaaataataactatgggttctgacctaatgttatatatatatactttttgtttttttgagacggagtctcgccgtgccaccagtctggagtgcagtggcacgatctccacactgcaatctccgcctctggggttcaagccattctcctgcctcagcctcctgagtagctggaactacaggcgtgcaccaccatgcccgtctaattttttgtattttagtacagacagggtttcaccatgttggccaggatggtcttgatctcctgacctcgtgatccgcctacctcggcctcccaaagtgctgggattacagacgtgagccaccgtgcccggccaatgtatcttacataataggacttagttcctggtaaatggtaaattaaaaaagttaaaactacatatgttatgcatgtttccttttgtattcaaacagttcttctaattagacatcagtgtcattattttatagggaagaaaactgaggtttggggaaggtggagcagcttacagccagtgggggacagcactggcttcaacccaggttgctggataataaaaattgtcacttgagagttttgctgatcaaatgcttctaaatgtcagcttagaacatattttatcatatgtcaggaattttctttcacatttgcccacctttataatataaagatatgtgttttacaggtgggcaaatgtgacctgtatacaccttgtaaatcacactaccatattttctttcatttagcattttttttccttccacatggaactggagaaagcaagattaaattatataattatattgttccatttcacatcccacctgatgtgtttttggtgtcctcttatacacttaaattatttgagtttgactcaagttttcattttgtttaaactgtttgctttcactgttacgaatagcagtgaaaagaaagaaatccgttacctcatttcataatgaaaaaagattataggtacattatgttcttagtttaacattttaggtgtaatacaagaaatctaaatgtgttgactttctgttctttctttgatggcgtttaactctctcccattaaactggtgctttttttacgaaattgtatttattctgtaatcgttaagaatttcttatcttttctattataacaccctggctttgcagtgctgagcagtgataatttaacttaaaaatttattgaaactgtgatgtacaaaggtttaacaaaaggatattacttttctagtttattccaaaactggggccagctatggtggctcactcctgtaatcctagcactgagcctgaggcgggtggatcacttgaggtcaggagtttgagaccagcctgaccaacatggtgaaaccccacctctactaaaaatacaaaaattgctgggcatggtggctggcacctataatcccagctactcgggaggctggggcagagaaactcttgaacccgggaggcagaggttgcagtgagccgagactgtgccattgtactccagcctgggcagcaagagtgaaattccatctcaaaaagaaaaaagaaaaaaacaaaacaaaactggggctactcttaccagccatgaatagtcaatctttccaaacacgtactttctgtgctttcatttttttcttctaggaacttggtttgtttctttacgtgtttatattttcttttatgtgtttaattaagttatatagtttcttacataactatttcacatctcaagtttatcttttaatattctatatttggcattgtgatcatatcattacagttttttctgtatttccctttcctttttcttttttgaatgtggcagaagagatttaaaaattcaagcaatccattaacatagcactaaaacacacagtacaatggagcttataatgcaaagtatcatcttccttccctgcccctactccctaaacacagccacttttaaccatttctgtattttattcttctgaaggccacttccatatctctagcaatacattgcacagatatttctgctataatggagtatatacatttctgcagagtaaattggattctccatgcatgctcactaaaaataacagggtttatggaaagaaaaagtgcgtgtagcaaaccacttaaaacagcttggtaactagagcgaagaagggtttttaaccagagtcaggaaggattgagcctgttgatttatggagttcagggcaaatgcatcaaagttggggagaaagatgtaataaacacttctaaatcagagcagatgggccagcctgagccaagagacatagtgcatggtactatatttctctgaggcttgagtcagcgctgtggctctgctttgcgttttgctttgttcctaagtggcataaaacaatgtgctggggcagattgtacatatgccaacacgactaggttggttgccgccacttctcactggaaacacatttcatacttgtgccaggaaaatggacttttccttgctcagtccattccctcatgtgtttcactgctgagttaggttttgtcggtggagcctgggtcacatctttatcttggctataatggaggctggaaaacatagtttttttatattctaccttgggaaagtggaattcataattaggagaactatcaaaatgtggagaatatgttaaaaagttttagatttttcaggaatcagaagcctaccacacgcacatgcactcatgcacacacatgcatataggtgtatacacgcacacgtatgtgtgtgtttcaatgtctgtaacttttgatttataaattttaacataatttattcaccactatgacacataacagtttagtgggcttgcattccctgctgtcttcatctcatatttcctcagttttgagttatgatattacctgtattttattttttctactgattacctctttattgtaatttattttaatttctatatcttactccattaactttgcttagaatcttttgacctctcactatgtaagaagatgatgttaatgccctctactcctatatccactgttctttcctcccttccaattcccattttctgtcagctgattatttttacattgccaagactgagaacattacattgttttataaccgaaatgaaataattaaacccttgattttaaaagttgaaaagcagtacacactgttaatattattatgataacaaatatttttcaccactgttgggggtaagattttatttttcacttgaggtccagtgcttggtctttgggaccctaaaaggagattctcttggcatctagatcaaatggtttgccttttaaattagtgcattaactgttcaatgtcttgccacattctgaatgtttcatatttgggctgtggcattcttttagatccttttggattttttagttttaattacctttcattttctctttgaaaaatcaagacaagcctttaaaatatcttgaagatcactcatattcttttttggaatttactctttttttttttttctttttttggagacagggtcttgctcttgtcacgcaggctggagtgcatggtgtgatctcagctcactgcaacctctgcctcctgggttcaagctattctcctgcctcagactcccaagtagctgggattgcaggcatgcaccacgatgcaccactaattttgtattttttagtagagacgggatttcaccatgttggtcagtctggtctcaaactcctgacttcgggtgatccacacacctcggcctcccaaagtgctggaattacaggcataagccaccgcacccagggtactcttagttctctaatttccttttccagtcttgactacccttctctatacctgctgcacaacaatcaccagggatgtttctccacttcactcttaaaggcaccatttcctgggtcctgcgatttgctcttccatggttatctttctcattttgttggagtacattcataattaactttttaaagcaaagggcatattgggtgcaggaggttttctgacacttgtgttaggtaaaatgtttttatttggactcaacatttgcttgatatttggctgcgtatagtattctaggttcacagtaacttttacttaggactttgaagataatgcttcattatatactagtgtcacattggggtagaaaattttgatgccaccctgattcttattcttttatacatgatctctctgtgtgtttgtttttctggaagcttttgtgattttttgatacattttatactgaaatattacaggtgtgaatctaaatatgagtctgtttgactcatcttgttttgcctctcatgactttcctctgggaatggcctacatatttaaggataattatattctttcttttttttgtatattttcttttcaaaaaactcttagcagttgtatgatagacctgctaggttgattctgtttctcatttcttctctcctagtttttgtcctgttgtgtttttacagtgttttgcatatttcctttattgtatcatttaattttttttgaatatttcaatctcatcaatcaaaatttcccccttgtactcagttatttttgtatcatgctatttgttttttttttttttttgtcatgtattttccttcagttgttacgggtatatacatttttttcaagttatgttctatagattatctctgtttctttagtagtgttttttttttttttttttggtcatagttcttttcttcatttgtgattgttgattattctggatacctgactggtgcagctttcctttatgtctctttcttctctaggcttttccactatggaaaaagttgcatagatctgtgcacatggatgagacattgctttagggtaaatgaatgagaagttcatccttaggcagaaggggttgccactaggttagcaaatgggatactcttgattcttggacatcagtgctcataggataagcctgtctttgtaggcaatttgaatgctttttatcagagactagctctttttcttttctttttctttttttttttttttttgagatggagttttgctcttgtcactcaggctggagtgcagtggcaaaatctctactcactgcaatctccacctcttgggttcaagcaattctcctgcctcagcctcccaagtagctgggattacaggtgcccacgaccatgcctggctactttttgtatttttagtagagacagggtttcaccatgttggtcaggatggtctctaactcctcaccttgtgatctacctgccttggcctcccaaagtgctgggattacaggtgtgagccaccgcacctggctatttgcctgattatctctggcatcatgctttttatttgggttttatttgggggaagtggagcaattgatacaactgtgttatttaattctgttgtttttattctcaattcttatactcacctctctacctgctcatgagctcatcttctctctgggagattagctgtttcttccactgtacctccatttatctccgcattggcttcctctactctttgtttatattttcatcacacacccacaaaagacttgttcagtctctcttgtctaataatcactaccccttcccgactttgttgtttttgctgttacaggtttttccttttgtattcatgtcctgtcttgagagaaaagggacatgaaagcgtatactcagtctgtcatcttgaactggaaagttttctctattgcattttcttattttttaataggcagcataatttgtgtatcttagtctgtgtactgtcatttcaccaaaatcttatttattctaatagtttctttattggttttctgagattttctaggtgggtaatcatattctgtaagtaaaacctattttcatctcttcttttctaatctatattcttattttttctcatttgtctagaacgactgaatgatgatgaatgaaaaaaatgatagcagacattaaatgtgatatttataaggcccaatttgaacttattgaattattaagtagaaaattgaaagtatcaacttcattgtatagatttctggcttactgagaaatgtatcagcaattttctgcataattagtgtttttgagtaaaagaatttggcacttacagccaaataccgagtatcttatatgtttctttttccaatagccacaattcagaattgggcttcctaaaacagtgtatccttccaatggcgtttcctaattttattattattttttaaaacgttttattttattttagattcagggggtacacatgcgtgtttgttacctgggtacattgtgtactgttagggattgggcttctagtgtatgtacccattacccaaatactgaacattgtacccagtgggtaatttttcaaccctttccccactctcaggctccctcctttcggagtccccagtgtctattatttccatctttgtgtctgtgtgtacctattgtttagctcctacttataagtcagaacatccagtatttgattttctgttactgagttagttcacttaaaagtttacctaattttatatgacaaagctggcaaatcactgttgggcaacatgattaatgttattgcaataagtcagttaaaaacaagtcatttaattggcagctatgaatcttcaactctaaagccaataaagatccagtgaaacaacgattactagaaagatacctgcatttgaaaaatatgcccctcctgattgacagctaaagaaagactcattgcaaaaacagactcattgctttttcctctgtcccttctttccctggatggatctaagatctgataagtctttcaacactgagtttacaggtttttttcttcatggagctgttcctgatctttttttcccattgtcttttaagtctgccttggagttgtcttcttagtgttcccgtggcattttccatccatctgtttcagagtagatatcccttagtgttgtaatttttaatatccttatctatttctctctaagagattgggtttcttggaatctcagttttttaggatgtggctaagaatcgtgaagtaggtagaagacttctaagcagcttgaggtgctaccataaacccatgtataaaagcacatacatttagtctataagagtggctactaggcccttaatcatatcccatcaactgttactttacatagaattctaacaaactttttacttagtttcttagcccacattagattggaagcaacacattagaagatggggaaaagttatgttgatgaaggtagggatgttggcaagatctaaagatgatatattgatagcctgaaaataagataactgatgggaaaagaaaaatctgttaaaagtacaaaagaatatagttttaaaaatcacagccattcatattcatttaatatagaaacaaggtaaacatctaccttgatagcatagtattataattgatgttccaaattatatctatcattgtgaagagattaatttctgttctatatgctgtgtttgaaatacaatattattgcttaaggtatgagtggggtgaactctcaaatgtgttgaataactcagccccctacagtgctagataaatgagttcttgttggtttctttctaaaagctgcagggtactggtgctttgcttctaatcattaattttcctttggttacattcacattaataataatgtcattaagtcatcttctgttagggcatttttctataaatttctaatttcttatgtcagttttggaaaataataaaatgacccctttctcttggctcttactattttttctttaattattttaatcatggaactacttatgaatttttctggtagaagccttagtataccattaattctgatactattttgcattaactctttgtgatattttctagacattgctttagctggattggtgggcaggaaaaaaggaggcgattaatcctccatttctgtagattgagattttgaggtgtgacagatacgatatgtagtaacagtactgcaaatccctgtgctggggcttgaaactattaatcttgttgtgaatcatatgagacatgtttcgtatgtctctccgtgtggttaaactcttccaggggagcttgggctggtggtgccaaagggtggagggggattgactaatctgttaaatagccttttatctgtgagtctagtttctcattagtatttctgaccagaagaatagatggttggaaatgtggacttttgtttttaattagtccctctagggatgagaggcttatttggaagaatggaattttaaggaagcctgacaacctcagtttccatgtgattgaaaatgtttggcagctgaaaaatgtttcacaattatgagttagagccagattttccactggctaagctgttctttgggagttagatacagggtaactcatatttccactttcaggtctcagtggctccgtttagggtgctgttcatgggactctaatgctccttccttcccaatggcccagaaggctcccatgaggtttattcttctatcatgtataataaactgatgaaataaccatatttcatctcatatttatgcattttaatcaggttggttgatgtttaccacagacatatgtctacaagcatttcattatctataaaagagagatttttttctttccttttttttttaaaacaaggtctcactgtgttgcacaggccgcagtacaatggcacaatctcagctcactgcaacctctgcctcccaggctcaagtgatcccccgacttcagccttctgagtagctggtactataggtgcacaccaccacacccagctaattttgtatttttcttttgtagagacgggctttcgccatgttgcctaggctggtcttgaactcctgagctcaagcaatctgcccacctcagcctcccaagttaagtgctgggattacaggagtgagccactgtgccagacccccaaaaagatattttcttcctcttttatactaccataaaattataatgctactgtattgccacagttttacaactgagtcagttttgcccaagatcctttgatctagccaaagttttgaagtagccaaaagtgcacagactttggaagccacgcagttcatctccctgtgcacttcaaggtgacaccctgacagatggttgctgagcacccactggatttttcccataaagtgaggcaaccagttcttttgttgtgcggttctagttgttacagttttccattgttgaactgaaatttgcctttctctaacttccacctattgattcttattcttccctcttgtatgtaacttgcctttgaatattcgaagacagcctcctcatagtcctcttatatctaggttaagcattccatccgttcctttcaggtgttatttaaatctcctggtttgcagatgcaccactattctgactaccattttttggacatagtctttatctctgatggcctttaacttaaaatggcattaaaatggtcctttagatatggcttgagtagctgaatgcctagtagagctgttttcctagaaggagatatatactttctatacttctgttttggaatacctgaaaagatagtttcttggcattggatatgttaagcagatgcacatatgttagggatgttgtagacaaaaagtgaataaaaagtatgttgggagggtggtgtccttacaagaataaatttaaatggctgttaatttttaacagcactattatgaaatatcaactataaaatatagggcatattacagtatataatgttggtaataatgtctgagtgaatattcttttcttagaaggtcacttaggtgcttttgttttttgaacaattcctgaataaacttgttagagtactttgtatctgtgaaagattgcatcccttgtcaaaaactttcaatttcacaaaaattccatcaacattttcccttcacagcaacatgatagtgctttaattttctcaatgtttggccacattgttaacttatttttttccccacttttcttcattctgctccttcctttgaggcagtgtttacttgttctttatagagttaacatttggtgcaatacaactagattgttagaaacttttaaaaaccctactcagtattgttattagcattgttttgtccattaccaaccattcacctgtttcctttcctaggataatgttaactgtgctttattagatgctctcagatatttaccaatgacatttttgtaaatggaatattgtttactcttaatcctaaagtttactcttaatccttaatcctttggaatgtctgttgaccttactgtaaatttaaggctgtataactgatagatttcagcaaattatggcagtgagagttttgatggtatctattttatgtcaagtaattcttcagtgactatgttaacatttcactgcattgtgtagagtcttattttgtttttccatgaggtaatttttaaaactacagggctattgagagatatttagtccagtaatacattccatataggggcattcaacgagaagattcttgtgttacaaggaaaggatgttaaaaaaccagaatctctcagtaaattgtggtctgtaacaattccatccctggggaagggcggcgcattgaaacttccatgactattaatcttgagagagagcatgcattgtcttgttggactgaagcctctagccatcttatcaagccagagctacaaaagtaggataactttgcatccctttttggcccactggtgaaaatgaaaatggtaggagtggatggacaatagattaggttctttgacaagtaagtgttgagtgacagtcatgaatatttcccatttcttgattttaccaattgtgtctctaaattcactcaccagaaatatacaataagaagctgaattttcttggattacttaacttgttttagtgaatgggtgagaaaggtttccagctgtagctgtcaggtttttttctgcagcaggcgcctgccttcagcgtttttgaggataacacgatacactctttcttcttttgctaccattaagcatattatgctgccttttgtaggcaggccaccaggctataagtcggactccgtagtctggttatgagctctgaggcatggagagggatctctggccctggcttttctactggttgctggatgaccttgggcaagtgagtcaacctcttctttatcttctttccactttgtaaaactgagactttctttttttctctagtcttaaaaaaaagtttgcaaccattaaatataaagggtaaacaagagtttcttgagtaagttaacacctctctggatactttagttaatatagataggattacttcttggattactacagtaaattaaacaaaatactctacatgcatttaacatgtattacagattgtctatattaaataaaagatgtaagtcgtgtctaatttgtagaagttatttcagtttcttttggaggaaagcaatgtagttatttatgttgtccctgtaagttgtattacagcattagagaacttctggggacactgaagaattgtttagtcacttaaacccttaaactccctttagggagtccagttgattcatgtggaccctccaaattatctcgtttcccaaattttaaaattgcattgggattatttcatctctttagggcttttttacttttcaatttaattttgctatgttttaaaaaaactagtggatgaattatgctcactctgaaaagtatttgggttccagtttacataaatttaattccagttttgtgtcccagaagtatgctatgtctttaaaattcagttagctcattaacactccagttctcatatttgagtgccctataaatctgtatacttgagtaacctgagctgcaatctgaagttaataatacaatctgttcttaggtatgtgaccgtaaaattccttaaagggagtcctgtgtttatgaatctgaaagtgttgagcttgaggtaacagtggggctaacatcttatgtgagggtttaaaaattataataatctactaatggtagagatgttttctaataagagtaattctgtgactcattttagttcccttgctttttattcctgtgagccatagaaagaacccactgtagggggttagaaatattttttcttatgattgtgggatgaaagagtggttgctttttccaaccaccatatgtggtgattaggcttttcagaatgacattggggtacacactgagcatacagcaacagtcttccaaataacttataataaataaagtatgtaagacgtttcccccagccagatgtaatcttcaatagtagaggaataaatttaaagtgacttcccacaggaaaatttgggaaatgcctggatggaccaagaaggcagtcatgctgttagaaataagcaaactcctttcctcctttcaggtgagaatatatgatggttcatttaaattttgtttttgtgatttctgggatttcttagaaaatgcatggataaaaccaaaaaactccagtgaactaaaagtctatttgaactgtttgaaccttgctttgcatttttgcttccaatattcaaaaacatttaagcagatggtactcagataagtgtggggacatctccctgagtgtgtagtaacagatctaatttttgtaaattgaattgtactttacatctaatagagacagcaccagttcctggggattcttgaaaggtggcaatctaaatcacctttattttctgagcttcctctcaggtgcctaaaacagcagcttcagaatttctgtgaggatgaatatgggtgttgaagtgggagatagctagagaacttgtcttgaaatggcattttgtttttcacagacagtgctttgagatgggttttatgtttatttaggtgggcttggggtggggggttttgtgatagccagcctttggtgcttgtactactctcaaaccatacccgagccacatgtgcaggcatgtgtgtagagacttgaggtgtactgacccaacttgtcaccagcctgggctctcagaaggtttcagaagtttgttcttctctctgctcgatgggagttaaaaagtatagcagtggagagatccagtgtgagggcctggacttccaaccttccagggagagctgggcttgggagactaagaactcctcaggtatgcctgaacatgcccagtagtctatagcaaggactggccactgaaacacaacagaagacatcctgccaaactagcatctcctgaaggcattctcgttaaaactgtgtattccttccattgtttttttcatttaacagatactcagtgagcaccttctgggaccatgtgttctagaaatggagaacaaagtaaacagagtagaaaatattttgccctcttggagcttagacactattgcaggaggcaatcagtaaacagatatactaatacatatttaagtcagatcccaataaattttatgaagaaaaatgaagcagcttacagaaatagcagagtgaagggaagggctatgatagatggttagatgatagttgtcactgaccactgctctcaggtggtgccttttgagcagacacttggtatctgagaagaagagttggcagcatgatagcatgtgcaaaaggcctgaggcaggaatatgtttgtcctattggaggaacagcaataagcttggtgtggttgtagtcgggtaagcaaagattgtaagagatgaagtcatggaagtaaccagtggaacaaaatagggatgtccattcttatcattagtaatcaacattatgctggagagtctaaataattagactagaaaattgaagagttgttattaaaaaaaaagaaaaagtaaaattatttgtattttagtgaacatgagtttatgcttttgaaatctagaagactttcactaaataatttagaatcaatgaaataattgagagaagaagcttgaaatacaatgactgtttataaaatctataggttttcctcatattattagtaagaaatagccagaaatggaaaatgacaaagatatcctatttataattgaaactataaaatactttagaataaattttacaagaaagaaagacagtggatacataaagaaaagaataaaatcttaggaaggctgttaaaatcagactaaaatatactgtgttcttaggtattcttaaacagtagcacataacaccatttaatacaaccccaatttgaattccaaaggggtttttaggttgttttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaggtttttttaaactacctaaaaatatttaaaactatatataaaaaatacatgccccaaatagccaagaaaaaaacagtgaagaagattttctattgcctgaaattaaaatttactgcagtgccatgtaaacaagctatggctgggatttgacatatggaacagggggttagcaattttttttctataaagagccagatagtaaatattttcaactttgtgggctatatggtctgtcttaattattcaactctgcccttaaagcagtgttttagtccattttgtgttgctgtagcagaatgccactgactgggtagtttacaaagcatgagatttatttcttacggttctggaggctaggatgtctaaggttgaggtgcctgcatctggcaaggaccttcttgctgtgccatgatgaaggaaaagagagcacgtgcaagagagagaaggaagggggccaaattcctcctttttcaagaacccactcgtgataaagtcattctgtagtgacatgagggctctgtcatgagagcttcattcatgagggctttgtctaataacctcttaacagtcccaccaaacactattgcactgagaattaagtttccaacacatgaactccagaggacacattcaaaccaatgcaagcgcagaagcagttgtaagtaataaataaatcagtggatgtgactggatctcttcattgccagtggttggccaattcatgatgtagatcttaaaacaaaatagtgctcagaaatagataatatatggcaagagtgctatttcaagtcacttgggaaggatagtttactgaataaatggtgctgacagtttatgtaaattctacttaattatacatacttaatgtatgatgctttaaatataaaaaccaaatagtaaaacaatagaaaaaaatttaagagaatattgttataacctagtgttgaagcaaagtttttaaacaaggcagaaaatatagaagctataaagaaagtatagatatttggctacataaaaaaggaatgttattatgtattataaacatttataaacaaaaataaacaaaaataaaaatggtattctgtgaaaaatatttgcaacacatataacagaaaaagggctattttctttacatccagtgtgcctctagaaatgacctagtaaaaacagggcaaagaacagtttctgaaaagaaaagccaagtgggcaatgactgtaggaaaagatgctcagtatcatagaagctgtaaccttttgtaaaatgggatagtaatagtacccacctcttagtgctgttggaaggattaaatcaaatcatacaaataaagtataagaaagtggttggggccaggcgcagtggcttatgcctgtaatcccaacactttgggaggccgaagcaggcggattatgaggtcaggagtttgagaccagcctgaccaacatggtgaaaccccgtctctactaaagatacaaaaattagccgggcctggtggcacgcacctgtagtcccagctacttgggaggctgaggcaggagaattgcttgaacccagcgggcagaggttgcaatgagccgagattgcgccactgcactccagccagggtcacagggcgagagtctgtctggaaatcactgtactgctgcaaactttctaaaaacagagtacatgtagttcactgccttttccaataaaccttttaaaatttattctgttttttcaacttagcgtcattacagcataatcttttggtgtaggttataataccaaaatgctttcagagaattaaagtatagggatatttcctacagcatccctggattttggatatatcctacctgcttattatagtggctcttttctcctttactggtagactgtcacctgtcacttccctgtgctggctgtttagtctaatgcactatagcactttctttaaccctttttttttttaatctctacttctgattgggaaaccagagagctaaaatcgatcaagatcaaccatagaactgttaacagagagaggaaagtaggcattctttacaattaataaactaattatgattttgtagtagatctattttataaatctaaatatgtatcagtatttttccaaacatctcatcttttttcagagaaatttactgtggggctcctttgaatagtagaatcccccttttcagttatatacatacatgtttatattctctctatagcacatatacatttgtatatgtatgtgtatatatatactgtatatatactacatgtattaaattctccttatggtatggttactatgtaaatcacctgtaaataaaattattttataaatataaatataaatgtaaatatttaatatatttaatattatattaaagagatatgtatgttctatatagagatatgatatatgttatagatataacatctatatctgtgttatatatgtatgagagtgtgtgtatgtgtgtttgtgcgttctctttctttatggcaagcatattaaaaaaataacagaaatccaagacaaaaattgcttgagtcttttaatcaagccattatcttcattttcattcatgtcactatgtgaatgcataatttgcatagtaatatgtaggaatatcatgagtagattttaatactttatattttcatttaatgcttttctgctgtcttttgtttttaaagttgtttcttcctttctctcagtactccctgtgcacaattgacatgtccaatactcatgcttaatatgcttgtttttatattttcaggtatgaaagacttttttggacttaatcattgtttccattttggcaccatttttgtccttatctcattaacatagtaagcctaaaatgtcctaattccaggaacggataaaaattccattccattttatattcaaaggtttggatttctaccttaatccatttcttaaagtggctaatgatttttattaccctagttgtctctagggcagtagcctttctcaaatcattttagtataactttacaaaatgaatgctgtaaatatactatgaaaccttcttgagatcattcccaactaagaatcaaaattagtgacttatctaaacattcacattcttttatatgttgggaaagttcacatcattgctcttatctgcctctaaattctttctctctggatcgatagtttcctgctggttttcagaatcaagtgcttcttatttttctgaaccttattaatcttaattaggcctccctggctctggggattatttagaatttcttcaggtaaaggtcacacctatttgtagttcttaatctttgcattttatctactttgcgtgtcaaatgttcaatgaaatggagctctactgtagggactcaatttgttagactgagtactctttcacgatcatctacatacatcaggttttattcagagacttctaaaaggagctatgatttttagtttctgaaattccaaaccccaataagccaaacagaacataaataaaaatagtcgtatagagcagcacttcccaacctttttggcaccagggactggtttcatagaagacagtttttccacagactggaagacaatttttccacagactggaggggtgggaaatggtttcgagatgaaactgttctacctcagatcaccaggcattagattctcataaggagcgtgcaccctagatccctcgcatgcacagttcacaatagtgtttgcacttctatgagaatcgaatgccactgctgctgctctgacaggaggcagagctcaggcagtaatgctcccttgcctgctgctcacctcctgctgagtggccaggttcctaacagggcagggaccatactggtccatggcctgggggttggggacccctggtataatggatgtagtatcagtcaccacagtctcctgccttattattccatgaagaaaccaagaaaatagttttaaaagaagattgcgactatttagtttagaacaatgtgctaggtagagacttaactttttcttggctattatcacagatagaataggaatgtttatgtgctcagctggaggggtggcagtttatatttgtatataaatatagattgggataaaggttttgaacttaataataaatggtgtcttaagcttacatgttttagttttcagagcagattatactaacagcagtaacaatagctatgctgagaagaatgcggagaaagaggaatgctcatacattgttgatgggaacataaattagtacagctattatgggaagcagtatggagactcccagaaaactaaaaatagaactgccatgcgacccagcaatcccactgctggctgtgtatactaaaaaaaagaaatcaacttatggaagagatatctctgctcccatgtgtgttgcagcacaattcataatagccaagatatggaatcaacctaagggctcatcagtggatgaatgaatgaatgaagacaatgttttatatatatatatattagactattattcagccatagaaaagaatgaaatcctgtcatttgcagtaacatggccggaaagtcaggccgaggaagacaaatacatgttctcattcatatgtgagagctggaaaaatgatcttatggagctagtgagcagaatagtggtaaccagagtcagcaaatagtagggggagtggagaatgaagagaggttggttaatgggtatcaaaatacagttagaagaaataagttctagtgtccagtaacacagtagggtgactctagttaacaagaatttattgtatatttcaaaatagctagaagatctacaatgttcctaacacaaggaaatgatcagtgtttgagatgatagatgtcccagttaccctgatttgatcagtatgcactgtatgcatgtatccaaatagcatatgtgccccataaatatgtacaactgttatgtgtcaataaaaaacaaacaaaaatagctatttcttctaatatcaggcattggtcaaacaaatatacttgcttctttttataacctcataacctaaagggatagttgctgttaatcatttccattttacttttgaggaaacatgtatttagacaagttaagtaactaacctttggataatcactgaaaacatagaagccagctcccagaataatatcttctacaaagtagaagagattatttttgaattagtgtctgagctgggactaaaaatctaggttaatctgatattaaacccatgttcttgatctttgaggtacatttcttctcacttgattgccacattaattatgtccaaaggccagtggcacttaggttctatagaaatatttgtgtggaataaaaattgtgttctaccaattctccttgcagttgcttgtgtagtggataggataatttaaaatcatggcctggttcttgaacaatcttattttgtcatctttgagttttatgaacagcagatggcaacaggacaatggtcagtcagcttgactgagcagtgaaactttgttcagtgagcaccggcactgggaacaactggtcagtcatatcattcagatgggaatggctctcattagctttgaaactcagatattaatgactaattgccagtaagatcaggcaatgctggtcaaccaggcaacttaacctgtgctccatgtggaaaggctgcttttgcagccttttaagtttggttgtaaaatgtaaaattaatttttcaatctcaagtttattcagaattctattaaaaacaattgttctttagccattttggtatgctgttattctttaataaaatatcagactgtgaattattgcctcttctctttaactttgtgttgctgtgttcccaaagtactttatccatataatgaatgcattacatatattatggttatttgattacatgcatattcccagcttaaccaaggactgtttgaaggcagggctgttttatacaattttgtatttaacaggtaatagacttttaggtgatcagtcaatgttgaactaatttgtactgtaaaatgaaagtccactgtttggctctgttgttcataatgtaaatattcatttacttaaatttaactgaacctatagtttagctggaaaagtgaaaattttatctaagaaaataaatgtaagtttaggtttctgaggctgtctattgtttacatgggtaaaaagctaaagccctcactgtacagctatttcaaatgtttaacatatatttactcatttattccttacattagcagaggtagttacattgaaaatactgagtcattgagaggttgagtaactggccccaagacacatactaacaagggttgagctgggatttgaacccaggcagtccaattccagagtctgtgctcttaaccaatattctatgcagcctcatttatctgttatgtgtatgtatgtaagtcaatatgtacagagagattgaaagagactttatcttatattttatagtgaatgttattatcacttcttggaaaaatacagaattttgcagaggaatgtatagttttctaaggtcaactttcaacgtcaagtaaaataatttaaaaaaattttcatgtagatatactttgagagacatttagatgcagtggaatgggtttggaaaaggaccaacaaaagaataaggaaatataaatcatgctattgtagaagacattgtaaacatttcattctgagagaattttataagggaactgcaagtgtttttcagatatttgaaggtagaaattgagagagtttggctttgttctttatagttttggtggacaaaattaaagtctttggtagatgctttagagcaataggattttacaccatttaaggaggaaatttttgcatggaaggtggccttaggaaataatgagcatttttctatcaggatgcttagatagaggctgaaaacagggatgtcactgaggataatcaagcattcggctgattgagtaactgaactaggtgatcacatttaagttaccttctaaacctgcaacttaaagattctaataacttagaagggattctgttttattaatttactatgtaggtgatttctagtgaaacttatgatcattaataccagtggttgcgaaaaaataatgcctgttacagaattattcataataagctcatggaaattcactcatcatacttagtgtttattatgtgtcagataccttgttaagcactttatcatttattacctttttactcttcacagtaaacttctggagtgagaactattattgtcttctagatgagaggttcagaagtgcccatgttcacattaaccagtaagttggcatggccagagcttgaacccgaggctttctgactccaaaacctatatgcctaactactgcacaacctttcaactttctagttcagatcagaaattgaaaatcaaggtaattaacatgacaaggttctcagaatatgatacttttgttatttacataagtagaaaaggttcaggccatccctatcagctggagcagactgctataaaaaaaaggaagaatgaaatagaagaattagggaaaggaaagagagcaaggatgttgtgtaggaactatttcatgtctagttgaaatgtgttataaaacttaaataggttttttaaagttctgttttgggtggcataaatttataaagcaaaattccttcctccctccttcgcttccttccttccaaagagtattgaggagattttaatcttttttaaatttttattttattttttgagagtctcgctctgtcacccaggctggagttcagtggcgtgatcttggcttatagcaacctccgcctcctgggttcaagcagttctcctgcctcagcctcctgagtagctggggctacaggcgcatgccaccacacccggctagtttttgtattttttagtatagactgggttttgccatgttggctaggcttgtcttgaactcctgacctcaggtcatctgctggccttggcctcccaaagtgctgggattacaggcgtgagccatcctgcccagccttatctttaaattattcagtaaacaacagtcaaaagaaaaatcttagccacattaagttaatagagttcagttgagcaaataacaactcgtgaatctggcagcctcggaaaccagagtaggctcagagactctccagcgcagccaagtggtggaagattttgttttttcactctttttattttatttttatttatttatatattttttattttttattatactttaagttctacggtacatgtgcacaacatgcaagtttgttacatatgtatacatgtaccatgctggtgtgctgcacccattaactcgtcatttacattaggtgtatctcctaatgctatccctcccccctcctcccatcccatgacaggccccagtgtgtgatgttccccaccctgtgtccaagtattctcattgttcaattcccacctatgagtgagaacatgtggtgtttagtttgctgtccttgtgatagtttgctcagaatgatggtttccagcttcatccatggccctgcaaaggacatgaactcatccttttttatggctgcatagtattccatagtgtatatgtgccacattttcttagtccattctatcattgatagacatttgggttggttccaagtctttgctattgtgaataatgctgcaatgaacatacgtgtgcatgtgtctttatagtagaatgatttataatcctttggatatatacccagtaatgagatcgctaggtcagatggtatttctagttctagatctttgagaaatcaccacactgtcttctacaatggttgaactagtttacactcccaccaacagtgtaaaagtgttcctatttctccacatcctctcaagcacctgttgtttcctgactttttaatgatcaccattctaactggtgtgagatgatatctcaatgtggttttgatttgcatttctctgatggccagtgatgatgagcatttttttcatgtgtctgttgactgcataaatgtcttcttttgagaagtgtctgttcatatccttcgcccactttttgatggggttgtttgattttttcttgtaaatttttttaagttctttgtagattctggatattagccctttgtcagatgagtagattgcaaaatttttctcccattctgtaggttgcctattcactctgatggtagtctcctttgctgtgcagaagctctttagtttaattagatcccatttgacaattttggcttttgttaccattgcttttggtgttttagtcatgaagtccttgcccatgcctacgtcctgaatagtattgcctaggttttcttctagggtttttatggttttaggtctaacatttaagtctttaattcctcttgaattaatttttgtgtaagatgtaaggaagggatccagtttcagctttctacgtatggctagccagttttcccagcaccatttattaaatagggaatcctttccccatttcttgtttatgtcaggtttgtcaaagatcagatggttgtagatgtgtggtgttacttctgagggctctgttctgttccattggtctatatctctgttttggtaccagtaccatgctgttttggttgctgtagccttgtagtatagtttgaagtcaggtagcatgatgcctccagctttgttctttttgcttagaattgtcttgggaatgtgggctcttttttggttccatatgaagtttaaagtagattttttccaatgctgtgaagaaagtcattgtcagcttgatggggatggcattgaatcatgaagaaagtcattgtcagcttgatggggatggcattgaatctataaattaccttgggcagtatggccattttcacgatattgattcctcctatccatgagcatggaatgttcttccatttgtttgtgtattcttttattttgttgagcagtggtttgtagttctccttgaagagttctcctcttcaaggagaatacaactcacatgccttgtaagttggattcctaggtattttattctctttgaagcaattgtgaatgggagttcactcatgatttggctctctgtttgtctgttattggtgtataggaatgcttgtgatttttgcacattgatttttgtatcggactttactgaagttgcttatcagcttaaggagattttgggctgagacgatggggttttctaaatatacaatcatgtcatctgcaaacagggacaatttgacttcctcatttcctaattgaataccctttatttctttctcttgcctgattgccctggccagaacttccaaccctgtgttgaataggagtggtgagagagggcatccctgtcttgtgccagtttttaaagggaatgcttccagtttttgcccatttagtatgatattggcctgtcttgctaggttggggaagttctcctggataatatcctgaagagtgttttccagcttggttcctttctccccgtcactttcaggtacaccaatcagacatagatttggtcttttcacatagtcccatatttcttagaggcttttttcgtttctttttactcttttttctctaaacttctcttctcacttcacttcattcatctgatcttcaatcactgatacccttcttccacttgatcgaatcggccactgaagcttgtgcatgtgtcacgttgttctcatgtcatggttttcatctccatcaggtcatttaaggtcttctctatgctgtttattttagttagccatttgtctaatcttttttcaaggttttagcttccttgcgatggattcgaacatcctcctttagctcagagaagtttgttattactgatcttctgaagcctacttctgtcaactcgtcaaagtcattctccatccagctttgttccgttgctggtgaggagctgcgatcctttgaaggagaagaggcactctgatttttagaattttcagctcttctgctctggtttctccccatctttgtggttttatctacctttcgtctttgatgatggtgacctacagatggagttttggtatgagttgtcctttttgttgatgttgctgctgttcctttgtgcttgttggttttccttctaacagtcaggaccctcagctgcaggtctgttggagtttgctggaggtccactccagaccctgtttgcctgggcatcaccagcggagggtgcagagcagcaaatattgcagaacagcaattttttatacatatttctttatgtatataggcaatatttctggtaaattcctgggaatgaaacttctcattcctacattatcagcattttgaactttagtaggtattgtcaaatgattttacagtagttgtaccatttacacgctcaccagcagtatgtgagatgtcctgttgtgatcaatctgattgtgtgaaatggtatcctactgggtttaaatttgcctttctgtaattgctaatgaggttgaacatcttgtctgtaaatttgcttccacttttctattgggggaaaatttttcttactgatttgtggatttctttttattatttggctaagaaacctttatgagttatatatacattgcaagtatcctttctcagtctgtggcttgtgttttcactcttttaatgttgtcttttgatgcacggaagttttaaatttttctgtggtcaaatttattcatcttttcatttatggattctactttctccgtctcacttaaatccttccttatcacaagatcatgaagatattttaaaatattttgaatagttttaaagttttacctttcaaacttaggtctctagtcacctttaatcatacttgatatatttagggtgatttaaggtaagagctctgttttatttttgaccctacactctgcatcttttaacagtatccactgttcatgtacacgtggatttgttcatgggctgtccattttatgtttctttgtgtctttttagagccttacaatacctctctatcttaacaatatagctttataataaatttgaatatctgatagggcaaatctcccgaacttgctcttcttcagttatttttggtggggtgggagcagggaggagaggtgatatttttagtccttttattttctttaggaatttgaagattaattgttaagtgacacacacacatacacatacacatgtacacacacacacacacagttcacatttttatgggaattgcatttaatttatagataatttgaggaatgtgacatcatggcaatattgattattcctttccatgaatattggattgtctttatttattcaagccttcctgtattcttaattaatctttgcatcatggggaggagtgtggtgctggctgttaaccagggtggggactattgactaacatctttgctacatctggggtataatagtccactggtactggggcatcaggctaaatagatgagaacagataaagtataaaaattgggtaggtttccagagacccaaatctgtttgggttaaaggcaaatctgtagtttgagtgttcagattgccatcagtaggctggtttggcaggcagagaaggttgacatctctcgatcgggcaaaggattctatctctcaattggggttaatcgggaaacgactcaggcatagagcatcaggactctatagtcatatctcagccacagactaactggacagtatggccagaatctagtcactgaaagactggacaataggataaaacaaggtacagagagacaaagtaaaagggagtaccacctggtactgagactagaagtacagggatatcaagagaatgctactgagccagctcattcccaggcaaaggcttattatgtttcattcttcagcaccagcacaaaggctggaatatcagtggagataaacccaaaggtaggagagtcccaatcagggggaagagggaaggagtggggagccctatggttcctgacatgctttgctccctgatgaggtaatagaaagctgaagcagtatatagctgatataagaagattcaatgtagatagaaagaatatcttaaactaatgtctggataaaactatattaaattaagtattgtttgacaacagctaagaattaatgagaaaagtccttaaatatctctctctctatattttttgagtgagggtatcactctgtcatccagactggagtgcagtggtgtgatctcagtgcactgaagccttgacctccagagctcaagcagtcttcccacctcagcctcccgagtaactgggaccacaggtgtgcacttctgtgcccagctaatttttgtttacctttttgtagggatagtgtctcatggtgttgcccaaactggtcttgaactcctgagctcaagtgattttccttcttcagcctcccaaagtgctgggattatagatatgagccactgtgcctggccaagtatttacatttaaagaaatctcactttaaaagtgtttctgtgtaagtgtagagcttagaattgtgaaggctatatttatgtttgtctatttcaataaataatttatctaaagatgaatcaacagctcacttacctttttatttcagtaaactgaaaataagaagccacaagctctcaaagtacctaagacaaaatacactatttcttgagggctgatctataatcctgagtctataaaatcatagaagaagccactgggtttttaatgttaggaaactgattgggaaacatgttaagtattgatgtgtaggaaagactgaggtgtttgatgacagatgaaagtgaagaaaggctggtgaagcaggagatggaagggcacagtctggggactgtgtgtgtgtgtgtgcatgtatgtgtgtacacacgtgcgcatgtaggtggatgtcttaaaccacagcacaacctgactagaagtgtatgttgttgtagaagtaataactaggcaatgaatggtttcaaaaacatgttagaaatttaagtttccttttgaggtaatattccatagagattctaaaagaggttgctcataaatcaaattgtgaggagctccaacttaattataagaaaaaaataacacagttaaaattacccttaaagtaattagcataatttttttgttttgttgttatttaaataaagaacagaactgttgttgccctgagggaaaaatggataacaggcagtttgctcatgtggcttatactttatgtatgtgtgcatctattgtaatagtaacagataatgtcttctaatagctcatggaagaaattagtttcttttcgagcaaaatggtagccttgtggaagctgacaaaagtcatattataatgatttttggctcaataaagtaatgatagcttggaaaaagtaaaggagtacggcagcagaagaaagatgactgtaacaaaacaaattatttgaacaaaagataactgtttctttaattggattctcatggaatattggtttaaaatatgctgaccaaaggcagtatctggaagacaggaacttaggatttctgaatcatagttctcctagcttggattgaattcaattcaacaaacttttgttgagcatctactctggagccaggtggcctgagtgtggttcttggttctactattctacctctctatcagtttcctcatctataaaacagagatataatagtagtctttatcttctgtgattttttttttaggataaacagaattttaatgtatgtaaagtacttagaacactgtttgccacttttgcacacacagaaagtcaactgaattagagaccggaaactgaaaggtgcttatactgtcttagtgggagagacagataagaaacccaacaatttcagtagtattttctgataataccaataacatgtttatcaaaaggttgctatgggaacccaggaattgaagaaaaaacgaccttagggggatagttttctggaataaaattcaaaaaaggctttcaataggaaaaaaaaaatcccccaaaagctcaggaaacaaaaagtagacaaagtgagaggctggaacacattcatttgtagctttttgagcttccttccttgctggacctaacactacatctggtcaccttttagatacttggtaaaaacacgatagagatcattttaagttctgatactattttcatgtgtactctcagtcacagcatctagttgagactaatggaattagaataaccagaatagcaaactactattccaaagtgtagtgctctgtgctgttagacaaaatattgacttctgggttgagttagaacaccacgaaggagcagcacttttatgtcatggcccttcttttctactctctgtcaatttgaatgaagcagaagagaggcaagtattatccagttagaaataaaagagagggccgggcacggtggttcatgtctgcaatcccagcacgttgggaggccgaggcaggtggatcacttaagcttaggaatgcgagaccagcctgggcaatatgatgaaacaccatcactacaaaaaaatacaaaaattagccaaacatggtggtatgtgcctgtggtccagctactcgggaggctgctgtgggaggatcacttgagcctggaagggggaggttgcagtaatctgagatgactcccctgcactccaatgtgtgtgacagagtgagaccctatctcactaaataaataaatggatgaatgagagaaagacattttaaaccaatatgttaagaatcacactttaggataaccttgatattgtaataatttatgattctctaacctgtgaaaattgtaaattgttaagcaataaagagaaaatacacttgtggatatgcagaaatgtgagtttctcagtgcatgggaagcattgagagaaggaaggtgtccatccagtctgtggtcccctggtcgtccctcgcctcccctatgtatcttgtcttgcttaggttttgacctttgtcttcatgttatcctgcattgctatacaacaattggggcatcttgtggttgaagttttaaggtaaaatgaaaccatggttactccttgctgtttcattggctggccctgcagttcttcatgcttactagcccccttcctgccattgctactacaaaagccctccagacctcctttggtgggaggagacatgagaatgtttttttatctcactgacatcctactgaaatcagggaaagacagggcagtgtaaagctttcagctcattctaacctggcagacttcttcaccattgcagctgtatgctgtctacccaacactggcttacagaatccaaaatggctctcccagagggcttcagaagctgggcagaagctcctaatgtttgtggagacacccccttagtctttctgaatgttttaccatcttaccaccccatcttctgtccagccccatgctgacacacacttgtacacacttgcacacacacatacacacatacatagacaaactcacacattcccccacccctctcccccaacatacagacacaccttcaagggcccagacaatgtttaatctctagttagacactttggtccttatttcatcctagaaggcaatcaaacttatatttcttttctttgagccagggaaactgctttaatattctccttttgccatatctatgagtaactttcatataagctctcaattctacagttctgcatggtccaagcaaagtccttttggaccatcaaaacaaaaccgtttctctctcaagctcttagagaatgtgggttgcaaaacaattgcttctgcaaagctaatttttaaattgctatttggaaaattataactgaacaataatgcctttgtccttggctgtatctgtctgtctctcaaagccaaagctttcagctttgctgggtaaagcaacaagattagtaagaataaaaataaatcacataatatttcaaaaatattatcctgttaaatcttattacctagacctgagttatttcacacaagaagaatactcaatcagctacatccttaaggttgtcataacaaatcaggctgatttccacacatatttataaccggaattattagtttttcaaagatatgttacaggtgagctaacattagatgtagaagggaaacttttgatcaaagtttaaattctgattcctcttgttcacttggatgtctttacgattcatttaaactttccaaaatcttatttctaaaacaggcataacaattcactatgacaatgcagcatattgtctgtacttttggatgctttctggaaggttgtcagcagccaactaaattcattattagagacttacagtgaagggaaatggttcttgaggtgacccctgttcagtccagaaatagcagctctttatttaggtaattaccattgtgaattgctgctaatggccacgttagtggaagtctatgttgtgatgaggaccactttaacattggggtggttttgattctttctgctacttaacattcagaatgatccatagctgaagcttagttactattaaaaatctacagtgttttgccagtgggaattccaattattattgcctggtaattaaaagacctgcttgcctcagagtttttgaaagaacaaaataatacatgtgattgtttcaaacttcaactctatttgaatgttaggtggttgttattaatttttactaactctcttactgtactctttttctcccttatctagttttcctgctctcttttcaatgctttgggaaattcatcttcataaagcttgatttttaattgaagcaaatttttctcagagtcagcaccacagtgtccaaggtcatctgttgtcttagcatcttttccactgtttaatctgtgtcttaaggcttctttggttctttttggatctgtgattgtttctgttttctgaacatgggatatagttccagatacactgcttttttatactgaactacattctgcgttgcttggttttgttttactttgcttttctctagtattttttgagcttagggtttatttttatcatttataaattggtttgaaaaaagattaattcactcagtgttcaacatttgaatcaagtgacaattatgtgcaaaatacagtggtattgctgggatatggtatgagcccagaatgcccaggcttctggcttgactacaggatcagtggtgctgtcattcaccagggctgggactgctggaggtagagctgaagtggaagggagagttggggcagaatgagtggatgatggacaattgctgttagctttgcatgtgggaaagtttaaggtatccagtggctggtgtggtaccttagagaggctctcactccaagtggcagatctaggtatcattagtataaatacagtaattgaagccaagggagtgaatgaaagagaatggagatgaattctctgttgaatgatcaccagacttgccatgtttttctatagatagataccctggttggaagtttgtgtgtgtgtgtgtatgtgtgtgtgtgtgtgtgtgtgtgtgtatgtgtattgtgtgtgtgcatcccagaatagccatagtggtgtggaggtgtgtatgtcttcagtgtatttggtaggcttcctggaaactacagttttaaaaatgattgacaaccataggctggaacttcttaaccatgttaacatgaatttatagtttgtttattgtggggctgttctgtgcattgtaggatgtttagcagcattcctgatttctacctactagatgctaataagttcctcccacccaatcctcatccccagttgtggtgaccaaaaatgtctttaagcattgctaaatgttccttgggctagataatgccacctgaataagttcttctctgaatttatttacagcattttgggaggagccacattaacttttatgttccagaatgcttgaaaaacacattcatgtctgcagttatcctgactgatatttaggaagcagtttactcctccatcctggaggatcaattgagtaattttaccattaaaaaaaaaatcatttgctgcacataaaagtacagatagctgctagatgcaaattaaattttgttttactttatatgtgtatgatatataaatgaaaaggggtgaccaggacatgttgtactccaaatagtgaaatagcctgtagttatgactcagtcatttcaaaggaattgctgtcacttctttatgtgtcaaatacattttaaggcagaccatcccaaagagtactcttggggtggaggtaagagggtggagtccaagtgcggtgaacatgaattttgtaatagtgatttgaatgtaaaaagttttaaaagagctagtgcttaatatttttaaacttcatttataaattccttaaagcaaaagaatataaaagtaacttaattacctgccatggaagctaaattaacttacaccttgaaaacctcctcttaaaataactcagattttaaagagtcatttgtaaggtaagttgtggcattgttgtaagcacctgcctgtatgtgtgttgctctgaaataatgctattatttattctattatagaatgtagattctgtgaggggaagggttttgcccattttcttcacttttctttctccacctcccacacttccttcatgttacagtacacagtggtgtagagtgtgggctgggttgcagcctcagagagtagttagtatcctgttttagttggctctccttcttctctgacctctgccggcctccccaacagccactgccaccacctcacagccaatattcttgatattctggttgaggagataactgaagcctaggagtttagatcagggtggtatcacttctcacagatgaatctttacttctggcatttactcctaactctcaaaaaattgtggtattaaatattttatatgactcctagaattgtggctgtaaagtcccagcctctgtctcaatcttctgtcaaatgaaggaagaagaaaaagatgaattctagcttttgcaacatgtattcagtccacgctcagaggccaattcctaccttcccaaaccgtgatcacagcccttgattgacagaaatgggagggaaaagggagagggagagaagagaagaggtttttcatcttgaagacaggaagagtcatatctggagagctgaggaaggtgggaggcctcctctgtgtacttctgttgtcacttgattggaatgactaaggacattttgaaaccagaaactgcattttatcactgaatgcagaattgggtttaggatcatccaggcttatacaacatagggggaagatggagtgactatcctgtggtaagaatgaatccatcttataagagtccatggcacagtggatatacagcatgcttatctaagcttaattactggttccatgtatgtacttcggcaagtcacttaacctctctagtcctaaccccacatctgtgaagtccacttagggttatgaagatttaatgtaattatgatataaagtgcttagtagttatagaagcaattgctatggtttaaatggtgaataaacagattgtttattggctcaggaattatgtgataactatttaagaattgtacttctggttgtcccgggagattaggattcttgtttggcttcactactgactagatagtattaatagttaagtcatttaactttgtagaccctggtttccttttattcacaactgttgaagttgaggatctttcatttggtaagcttgggaattctattttgttttgctgtttaaaaacctaggcctcttgttgttaacaatacctctattaactaatttgagttctgactcatctgctagatctaaatagccgtgggaatgtgaagcttttcacaaataatgctatgatttttcagataagtttttgctctccatgcaaatggagcaaattacttaattgacattttacaattaggtattaaagcatcctgttcaaggttggaggacagtataaacttatttaaaatgtctagtgaacacagtctgtcacagggatatgggaaaaaggcaaaattgtattaagatattatttgtaagcaagtgctcttcatttccaagcagtctgtccctgaagggggtgtaaatcatgtgtctgttctgtgcttagaattcatcccttctgccatatgtttattgtataaaccaagaagatcatgtattatcaagagacaacttctactcccggcctaaactttcaaatattattcatactctgttctcataaaaaattattcttagggtctgaaagaccatcattttcttttaggtatttctgtttgtgtatggtatttgcagcaaccaacatcaacagctggtttgttctctcatttttcaaggtaatggtagggatttaagttattaagaatcaaatctaacacacaaaaatactttgaacatgagctgtgtacaaattttttattgagttattaacctattggacattgctgctgctgtggggactttatcacatacatttaaaaactaatataaacaaatggagaatatgagttgacacagaagaaaggctcaattttatgccaaagtaatagctagcactatagcatgcttactgtaggcattacgttgagagctttgtgtgcattatttcatttaagcatcccaactttactacttggttgggtgttattacttcatcatttttataggcgaagaagctgtctcagacaggttaagtaagttgcccatgttcacacaactagtgagcagaagtgctaggggttgaatccaagccacctgattgcaaagtctatgctgaagttgcattttaaagtaacagaaatttccttcatacaacactggacttatttttttctatcaaatgatgtggcaaattgagagatttctggagaaattcaggcccaaacaatgttatcgctcagatcattcagatcattttcaacattagcatttaatgaataagactgtgtcttgaaccaaacatatttataaaagaattagaggaaggtaacttaattctccattcactggtgtcttagttgtaaaaccacattttgtcaaggttattggtcataagttattttaatagcttttccaaacttaattttctgaagttaataaaatgctgagaaaaacttagattatgtttaaaagcattgagtgaactaaaacctaagtaaagctatttactttgcatacatatggccaccatctaagatggttacttatccttgaaaggataatgtttaaaataatatttaaaataatctaaacctaatttcttaacattgaaatttttacaaagtatagttatgtataaatctgatactatcttactacaagagatactaaatgagtaacataaatattaagcataaaagatttaattggactgttacaacctactctcacacagtttaaacaaaagtcagttaaataggttgtttgtaaagttctgtatagtctagatttctttcttcttccttctctttcttcaccccctcctcctctcagcatcataatgattatcatcatccccatcaccactgttatcataatcatcatggctatcttttacattgttttcctcacaacatctgcatcagtaatttaattgtaagcaacagaaattaaggagcagtttatttagaaagatatcttgtagtttttagtttgaggacaacctgaagaatgaggccttgtagagctgtgccaagacaggctgctaggcttaagatggggaacagatgtcagcagatattcatcacttagggctaaggtcagttggttgagctttggggcagagagaccagtctagtcctgtaacaccagcgtgccatgcagaggtaaatttttgtgtgtgcaaagacctacaaacatctgggaagtaccttagaagaggaggaaacagcagatctagagaggaaggttgcaggaagcagtagatggtcttttcaggtttcaccatttaggcaaatgagtttttggaccttgtgcacacatgctgtttaatcatgcgtcgggctttctggagagagttttatttataattcttgggctatgtatccattccttggtcaagggaatgtggtactctttgattgactctttgattgataagataacattttatcttactaggaaagcataaacttccaaaggaaaaattacgtaaaggagaagacatggatgatagggaaaaaagcaacatatcatgtcatatcactttaccatgcatagaaatcataaataaaaatatttttcctttgatatagtagtcacaggagatcttttgccccccaaagtcatagctatatttatagtgtttttctgaatattatatagttttttaatgaatcttggtaaaagaagattttttaaccataacttgtttttaatcctataggagaggataataagttttagcttttataggccactaatttttttcatggcttttgtattttaaataagttattattaaaatagaaattaaaaaaatctacagaacttgaattaagttaattaattaagcagcatttcataataaattctgtgctgaaataattatgatcattactttattacaaaataactatctagaatgttgtatcagtattagtgtttatgttttatcgaggcatgtgcaatgtgcctcaggtgtcatcaaggatgggcatcgaatcactgtttcccttttcataatcaactcccaaaaggtgaaaatttcccctctggcttcctagtatcctaatatattattaatttatttactttattattttattattatttactttatttctattttatcctgattgtatctcttaaggtacatattcttcttttttcacatgtcatagttttttaataagattgtttttgagaatttaaatgttttccctctaaattctatattatgaagtgtgattgtaatgtgagtgatttttaaagttgtctgtacactaatttttaaagataattccagcagcctgggtgcgatggctcatgcctgtaatcctagcactttgagaggccgaagcaggaggattgcttgagccctggggttcaagaccagcccaggcaacatagtgagaccccatctctacaaaaataaaaataaaaaaattaaccaggttgatgaagtccacctttggtcccatctactctgtaggttgaggctggaaaattacttgagcccaggagttcgaggttacaatgagctgtgttcacaccactgcactccaggcagactgacagagtaaaatcctgtctcttaaaaaaacacaacacaataaaacaaaaccaaaaactacaagacaaagaaggctaaggaatgccagaaatccccagaaactgagagaatcatagatgatttccctctcagagtctctgataaggaaacaactctgttgacagcttgattttggacttttggcctcctgaactgtgagagaacacatttctgttatcttcagccagatagacagacagacagacagacagataaaattatctctctgtttgtaacaaaaagatcattccccctcaaattccccaaagtgtgtgaaacaacagcttcattgttagaacaatgctttctttgggtgttttgaagaggagtgttcattgtttaaaatgagtctgattacattgtcaccacatgttatatctgctttttctatatactttagaaaatatcttctggattgtatactccttgaagacagagctgaagtcttagttgtattggttttataccttattgtacttttgctaacagtgcattgcacctccataaactgtaatatggaaaagagataagtaccataattatttatgaggactgtaatatacagattgctgttaatattttcaaaacctattagatgtaggaatgtttctactgtttttcaaaaatgagtcatcaatgaaagacttttcataattcattcctttgtttctattgatagtggcttctatttttctccgtttaagaccattttgatattaaattctcaaatacttccatttacaaaaaataaaaggacaaaaattcatcaacacctgtgaaaagaagggaaaaaaaagaaaaaaattcggatcaccgctaacagctgattactaaggaacctgctcttaccgaacagcatgcagtgggagaaactaatgtggagaaaataatcagttttccttgttatagggatcatacaaccagaaggattttaccactgtcttacaacatacagggatgcaagccatggatttgggtccatgtgtttagagaacaatggaaatttagtttcccaaattggaatttcctctggactatatcttagcctcctgagcataaagaatatacctaatataaaatgtgtttaatgtttcttattttgttactagagaaaatatgaaggacataaagatgtcagatgtactatcctagtcactaaagttctttttgaacaactgataagtcaaaaagccagcagtagaaatttgactactggttcctggtggcctgactgtaccattagcgaagtgatttgtgccctgaggctatttacctttggttatttccccccaaaggctgaaagttctacaatatgcttgtctctgaattgagaaactgttcatttctctttggatcgtcaaagtagttgcaaataataaacttaagtcaataaaatgcagagttagaaagaaaatgatccatgttatttaacttcctctcttaatgtcacatttatatgtattggcatgtttctttgtatatacacagtaatgcatcacttaacgacaggagtacattctgagaaacatgttgttaggcaattttgttgtgcaaatattacagagtgtacttacatgaatctagaacctagatagcctactatacacctaggctatatggtatagcctactgctcctagactataaacctgtgcggcatgttgctgtactgaatattgtaggcagttgtaacacaatggtaagtatttgtgtatcaaaacatatctaaacatagaaaaggtacagtcaaaatacggtttataatcttatgaggctactatggtacatgtggtccactgttgaccaaaatttagttatgggcatgactgtatatacacacacatatataaagttgtttgactaaggaaaatatccaaattcataaaatcatccatttttataaagctttttttatactttcattttttatttggaaagttaacagtctcaggtagttcttctttggttcagttgcatagcacttctctctgtgctggtgaaatctagtaactccttattaggctaagctaaatatactctggttgacatcttatgttggcttagctgtttagtcaggaggtataattgttaataatatttagccataataaatgaagttgtctcacagtatgtattttaaaaaatggcaacatatggttcaaaacagagactcctaattagacaattattgagcaacaggaaaggatgttttcaaatttgtatacttatggttgtactctaaaatctagtagtttcctgatgcagttttatagttttctatcattagttacacataccatatccacattattaagaataaatttgctcactggagttacagcttctttaatattatttatgtgagacttctttaaaaagggaagaaataataatgtttagcctttcaacaagttagtctattgagtagctgctatgcactgatgccctgaagcacagcagtgaaaaaacagtctgtcctgtcatagggcttctagtctgatattgggctgattcaccacttttggtttaaaatcctagtttctcttgtctttaatatctgtctgtctctcttcatctttctttttctgtgaatacacacatgctatgtgtgtatatgtatctatacacacacacacacacacttatattgtgtatgtgtatatatacatatatttttaattaaagatatataattcatatatattccttaaagatacatatatatatatatatatgaatatatattctaataaataatgtaacagtataagtatcttgtttgggataatacatattatgtgttaggcttcttcagagagacagaatcaaaaggagatagatagatgagaggggatttattaaggggttcgttttatgtgcttatcgaggctgagaagtcctgcgacaggctgtctgtaagctagagattctgggatgctggtagagaggctcagactaagtctaaaggcctcagaaccggagaagacaatagcgttactctgagaacccagggcgagggagtagggaggcggttctggtgtaagtcccggagtccaaagggctggagcctagagttgttgcccaaggattggagaggaaggatatatcccagcccagcaaatagacgggcacatttaccttttctccttttttccttcggactcccagcagattggatggtgcctgactgcaataaggacagatcttcaagttaacacctcaacttaactatttgacacctcaaattaaccatcacaacatatatatatatatttattataaaaatctataaatcaggacatgaattgtttatatataagaataatacatagtttaagaattttaattctgcctttaaatacgctgtactatgtatcctcagtttcccacttaatgttctggttctgtattatgtctgccatattaatttttatcatagaattttgcttctgtgttgtttaaaacaaaacaaaacacagtgattgacaaggcactgtttctgctgaaaagttcagaagcattcaaagatcactgacaggttctgttttcacctgttcctcatcagcttttcatggttcaggtgcctgaggagaaacggtcatcaagctgagtcagagattcacattttcaggggtttgaaggggcaatgggttgagacactcccctttctgtttagaaggtaccagaggaaatattcaacaaaattttgttattcttccttaaaaagcatcaaccttataaacatcttttcatcactggcctgtagttctgttgaataaaatgttctaaagcagcaaacactgggtctgatgcattgggattaaaggtaaggatcaggggagcagcccaagggggcaggatgcccagatggctctgaggctcccccaggcaccgggagagtgagtacctgccttttcccagccccaggttgctgatgtgggggctagtatctaagcagtgatcctgatgaggggagtagacaatgcaaggtgtgtacatgtattccttgatgtattatttgatgagagttagtaaaaaaaaaaaaagcatccattttagcagcactcatgcattctatcactgatgctcaagttaacaacatgaagacataaattatagttttcacctttacactataactcttggggttataattttcttccagactcccccccagttctttctttcaagctgtagttagaatgtaggtcttatgcttcaagttactgtttgctactttatttgcaaatgttttttcctcaatatgaggccattgctgtaagatgtcctggcatggggagtggtatcatattgttgtttctaaaagtggtcctgaaacagttcagtattgaaggcagtgtagatatacttaatattaatctccctacttgattttgttaaaaaacctgacctttgacattttctagattagatattggactctttgatggttgcagcttattgagaatttggagatttgtcttgaatgcctttcttcagccattcctccctccccactgtcttgctcactgatcagcagcttgctgctgctccaggccagctgcaatattatggtttcagtgtcactgatgcagtcagttgtgttccgatttcagaattacggttggcagtcccagggtaaagtgatacgctttggcatcataaagtagtaggaccggggagcaataacattgaaagctatgtcaagattccaccctcatggaggtttcctggttacatttgaggctatggtttaaaatacatgaacttcacatagtataggtaaaatgtgtgaaaagggtgcatttataaatacaaccacacatatttataggtcatacaattttatagtagatgtgagaaatggtcatttttctttgagacagatttataaatgatttcttaagttatttgggtctccaggtagccaaaagaataatgataccctaacatgtttcttttaatttattggaaataacgatgacattaatcatcatcagaactaaaggaatactgtaaagtagattcaaaaacaccaatttatatgcttaataaaaattaatttatgatgagtaaagccaaaaacccaattctgaattttatttttgaatgtagttaagatgcaccaagtgaaggtggagatgtaggtaacctctgggaccatgacagtagtgatgatgaggagataaatatccacaactccaaccccacaccatgactctatgaaaagaacttcctatcttatcctcatcatttaggtctttggattttccagcccctattttgtattggtcctgaattaaacctggttactttcatggtatcacctttattttcttcctttgctttaaaacattggttgtggcttttttacttcctcttcatacctgttgatatactggttctagacaccactctcaccgctagttgcctggcccagctgccaatactgatggccaaaataagcaatttagtaaaaactggtggtaatggtgggtgtgtgtgtgtgtgtggggtaataaaatacaatcttaccatttatcttttatgtaatgttttgagaaaactgtattttgggtaacttactaaaacttcttttagtcagtaaaactgcatctcatccattgcggatgttcttggtacaagatttctcctatgagggactacaaattattgggtctcttgaaactggaaacagactctcactcttccagtagtatataaacacactggagggctcctggtaagggccctaggagtgcttcagaagtacggtacatcaccaagtacaatatggggaagagcttcagagccatagaatcctttttcctgcatatttaaaattccaaatgccataattacccatttatgatgtcattttggaacatatagcaagactactgaatgcttaaatttacacattatcttgactagttcattgtttttctgggttttagaaacacgtggtgaagatatggctcaaatttcttttgaaccactgggtctgctttgctaaatgtaactttacaacaaaatggatgtttatactggtaaatatccacaagatatttgggaaggccggaatggaagtctgcctgattcggtgtataattttgtgggcaaagataacataacagaaagtgcatcttgatatttggaaaaaaaagatcattttgccaaagatgtttccttaaagtataggttgcaaactcttggacagaatctggcctggggagacatgttttgcttggctttcatagtattcaaaaagaataaaaaggaaatgagtttggccccctaagtcagagactgtgttctctggttgtccacaccaccttccactgcttattaccttagttattcccattacttcttgaggtcatgagatatttgtttcgtgactcttgctaaatgaaagctctttgcagtctgtgatttgtgtacctcatcctttaagttgttgtcacactgggaagatgaacctccttttcttcctttttctttttattcttggcttcttttccaattcgggcaatagcaggcctcaagtggactttgggaaaggacaaatggaaggataggaggaaagcacgtccatgctctccagcagtggtccttggctgtcagaagggatggagacaaccaggggaaagcatcctcactgccagtctgtggccaggggaggagggggaaagaaaacttgttactcaacttgccttcctgtctgcttgcttcttgtccctgtatttttcagacatttgcagctgaggccaatttatccctactcattcactcagcaaatagttttgaggtctgctgaatgtggagcatcataccctgagagtggtaggcagtaggggaagataccacgagaatacacgaatccaccactatcatgggtcttcatttcacgagtgtggttttagcttacttatgagactttcacgtttcatctgtatcctttcttacccagccttattatctccctagaattattattcttatttcttaaaggttagctcttcggttgagagtacacagtggttgcttaacactttcttctggatgttaagtagattattcttagagacctgcttttcttttgagtgatcaggataattttcagcattttttttcagtaggctctattagctttagtctatgttttgcttcctttactaatctttgaatagggcagtatcagtttgtacaggctcatttgcccataaccagaaggtggggttcgctttgattctgctctcaatttgtttgctgtgggaatctcctcaggtttccacccaaagggtagagcgtgcagttcccatcttgatctctggtgtagaagctctgctgtacaggtaaggtcttctcctgtgctgccagctttccacttgtttttctgccactgagctagggtcacacactgaagggcctgcagagattagacagatgaaacaaaattagtgaagcagtatgcaacctatggtagctgtggaagggatttaaaggcagtatttctaaagtgctttgtccttttaagtggaatttgcccatgaccaaatatggtatttgggtatttagtatgatgccctggctctaaaacagtgtttcttaaatttttctgaatttttttgaccgtggtaacacacaaacacacacgcacacacatatgactattttaaaccagaagtccagtattttacatcttttggagtcctctgagaatcaactctcagaactgagattccttatttcagggatttgaacatttagtagcttttggcaaatatattcccaaaatatttctcaaaagacttaatggcagtttacatggcctttggcaatgtaaggaagattttaactatattcctttgtcagaatttaaatttaaattactttgtgacattaatgggtgaaatgccactttgtccttacttttaaacttatttttaaaaattaatggagcaatagaacattttctttgtttagcagtggtattttctcttttataataactattttattcatagacaatatagcaaagtgatcaactttttatgatgaggtgagccaagcacaaaatcttcttggatcactccttaaaaaaataaaatactgtcattcacaacctaagctattgtaagtatatctcacttcttctggtataatagacagaaacatgttactgttatagtccttgtcaatgaaagcattgcagaataaagaattgtaaatcaaataggaatggattgttgatatttttgtgcattatgaggaaagaaaattactcagctctttccctgaacaaaaggatttaaacctagataaaaattgatttttaaatattaaattgtatttctggagaactattattattgtatcttctcactaatatcctattagcaataatgtaatttttgaccttaagatttttgtgcctctgttgtgccactgctctccattgggcgtgacagagcgagaccttgtctcaaaacaaacaaatgaataaaacacaataaatttctcctctgtattcctaccttctctattaagtaatcaatgaatatgttacggaaaaatagtactatttctgctaaagaattcttttcctgaatccatttgtcacattaataacttagatacataattaaaaccctcttatcttggttttaatgaaagcacgtaagttatatattttgtttttctctgtgccatcttagttatatacactacaaaagatatgtgtaatttttgctgaaatatcctttgagttttactccagcacttttttgagtcatacccaaaaacccaaaagattttaagccttgcccatgtattatgaactacacataatttttgcttcacaatgggccaaaaattcatttattccagcagaattggaccaagttttagaaaataggaccatttatccatggtgatacagaagtgtagcagtgtttatacttttgatcattccttagggaagcatgaccttggtagacaaccagctggcttcagggaaaattgtacccttgatacgtgcttaaaacagcagtgtaaaatgtaactggctgacaatcttggttttggttagggtcactttcttcttattcacggtatgctgggagtacaagggatgatgtcagtttctaccctttagaactgttatgatggccagacatagtatttccctctgttgtcaacacttgagaaaaatttgccaagtggggacttacgaattgaaaagcagaggatattagtaattgttgttttaagaagagaaaaattcatttttcaattttttttagaaaagaacaaaggagttgaaatttaaaattctagaaaaacttgtttctaacaaaaataaattgatttttaataccagtatcatgcctttccttgttacttatcacttaaaataatctttaaattaatttctttctttcttgggtatgctttgccctagggcattgtggcaacatatatagtacaaccctttagggacctgagttaactcgtctttgcttccccagtattagcacatgtggttcaagaaattgttttaatatgaactgatgacctttggaatttatacaacattaaaagttaattgagagattgtatgtaataaataagatgatgaaagtgatttcctggtttgtactaatataatgttcaaattttcttatttggcattatttatctcctaattactggcacaatatggagcaaagctatgaggctcagaggttttctagtgtgtaacttgtctcttttgtttctgtagcagtgaattataggtgctgttaccatgtataagttttctctaagattctggttagctgatttaccgttgaagatttttcaggagaggagtgctgtcatggataagcagtctggcagaggatgtgtgacattgatgatgtcaggaaaatttttccctgtgtctctttcagaatggaggatggtgaggaaaccagaacgtgatgctttttaagaaaagaggacatggtaaacaattgagatttgattatatatttttccatatggaatatcatattctgaaaagattttctttccaatcctcaaagggaccagtttaagaaattagatgtattaagcacctttgaaacactatatcaacaacaaaacataaaacagggggattaaaaaatggagaaaggactcaaatagacatttgtccaagaaagatatgccagtggccattaagcacctggaaattgcttaacaccactaattattagggaaatacaaatcacaatcacaatgagataccacctcgttcccattgggatggctactgtcaaaactacagaaaataagtgttggtacagatgtggagaaattgcatctcttgtgcactgttggtgggaatgtaaaatggtatagcctctgtggaaattactatgactatttctgaaaatattaaacaattatggcatgacccagcaattccacttctgggtatatatacaaaagaagtgaaagcagggactcaaacagatatttgtacacctatgctcattgcagcagtactcacagtagccagaaggtaaaaggaacttaagcatccattgatagatgaatgtataaacaaaatgtgatatatacatacagtgggatattactgtttcaaaggagggaaattttgacacatgatacagcatagatgaaccttgaaaacattatgcaacgtgaaataaggcagtcacaagatgacaaatattgtatgaacccatttatataaggttcctaaaccagtcagattcatagagacagaaagtagaatgacaccaagggcttggaagaagagggaatgaggagttattgtttaatggctacagagttttgctagggaagatagataaggactagagacggatggtcgtgatggttgtgtaataatgtgaatgtacttaatgccacagaactgtacaattaaaaatgattaaaaggggaaaacaaaactatctttatggaatttttcagtcagcttgtaattataacctgaatgctaaacttggaacaatataataggtattaacaccatggtaacaacacttgaatgaaggtaaactgctggaattaataaatgataaatatagtggaatgataatgacagtggtctttatggttggttcaggttctaaatttgccaaatactgtgcagtaactcttgaactctcacttttttatttattagaagagcataagcatatttacagtaaggctttagttatgtggtacttccaaatgcctcctgccattgccaactccaaagaaaaatcctggaagagccaggaagggtcttctaaggacagaaggtgtggaagatgcagcaccctgattgtgtctcaaaagtacaacttggctttgtagtagaccttttcaacagttttctaaaattctatgacatggaagtcaacagtattaatagccaaatcacatgttacaatttcttttcttcatagaaacagattgagttgagatggagattaggaataagtttatgaaaatgtttttaaaaactgatggaaaagagtgaagatacaaaaacaacctgacaagcagctacttcaatctttgaaatattgttttggcagaaataattatgttgctacctacaggtggttatgctttgtttgatgtttaagctgacagggaaatggggcaaaaaacttttgaaagcatttatttactatttacccatgtttaactacatctctaataaatgtcctctagtccagtacaatacctttgccgccattgtgaccttttttcagtaggaacgggaagcttgtgttcagtactaactcagtgtttgtgtatttgttaccatcatgcatgtttaaaaaggtacacagaagcatgtattgtactgcgaactcgttattctaaaacaagtctggaataggaaaaaataggtggagagagttggcccagggcagtcctctattacaattagaacgattagagcttaggttataggacttctctttcagcatcctaataacattactggtcccctctaagatatgaaagacatcagagacttccagtcttgaagagttattcatgtaaattactgtgtctgtgtgctttttggggggatcaatataagcaacatttattgagcggccacatatacaatgtattaggtattctagttaggtacagaatatttgttagttctgaattccatgctcttgaatgatttggagtgctgaaggagatagtatagagaccaccaccaccccccgcccatgaaaaaaaattcctcaaaacaaagaaacaaagatacttaggtccttttctaagctgtttatcttttactaatatacaaagggcataatttgctcaatgtaatatctatttgccatgtgctgtgttcttcagtaggcattgtaagtaagagtttctgtcttcaaacttgtaatttagagtgaggttggaggattagacatatctatacagtgctgtgctatgaggtaaattgtgtgtcttcctaagagagagagttgaagcagagtgtgctgccttcaccttattactgtacttgattcttgcccttgtaacctggttttaggtttcatataatattttgcattgtcagctccctgaaattctactgggaaatggttacgagtacatagacaatctgacaagaaaaaggaggaaaggtaccatggggtttaatataagggaaagcccagctggttgcggggaccagggagaaagagttgtatgagatgggtcttgagggagggatagaatgtctgccagtgtggggaaggaagtctgaggtggaaaaccatcaatcacattcagagttgtgaggggactgacatgcctggagcatagagggactattagaaagcaagttggaaaggtaaggtcgattaactgacaggaacatgtttatctgaaatattttgaagtagctttcagaaagatgtccacttttaattttgcaaaagcagttttcttaggttcttcagtatttcagttctgattatacaaatcattgaggaaaaaatgaaccagtgaggatgtacaaaaatttcccaaatgttttatttctttgtcaacattatttgcttatttttcagctcttcatgtaattgtctttgtgctctgcttgttcccttttgtactttttccacacgggtgataaagccctgacaatttagtttttcttggtttacactttcctacaatactaaaatatgtgtaaccccctcactaacatctttgccaaaatggagttttcaagacattctctgaagctcaggactgtttttttgttgttgtttagcattggcatttctccagcggaatactagccagtggtccagtcatgtgtggaggaggtcatgctgattaacaaattactaggcatatattaatatgtttgctaacctgtgattaattgtgaggtttttctggctaacttgttacatgcacttggctacaaaacaagaaaacgtctcaaaaaatgtatctaattcagttgcgttgatatttgaagttcatcaaaattctatccttaatgattctaaattgtataaataatatgttcttgattaatgaagtatacgtgctatgattttaccattagttgtacttatatgtatgcattacatatatgaggttctcttgatttcagaaggaactgatacagaccagctttggtgtttcttttgctttttattagctttatattcggatagaaaatattaaaagggctataaattgcctatccaaaatattgcttttttttaaccttatcagcaggcagaatagttgctgtacttggtgtaggtaaggttcagttgtctgtaagaaaacaatcttgctatagattttgaggaagaaataaaataaaaaatacagatagatgataaatgttttgcttttcaaatgtcgatgttgtactttcaggaatatggaagctttatggtttgcctatctgtatcagttctcctagaataacaacttaacagttttcctggttggattgtgttaaaatctttaaaggctatattcactaaaacatatgtctaatgtttgggcagccaaagtctgtgcaatcattttaacagagtataacttagcagctctcttattaccacaaatatcttattgttaaaactacattaaaataccatcaatttggaacatgctacttcataattaaatcattctgggatgtgatcaagtatatacttctgaactaccttaaaaatggattgtgctaagaatgcaatagcataaataaatttaaagagaacatgcataataaagttaaacgatttgttttaatggagtttttatctagttaacttttcttgagtgtctacaatgttcagagcactgtgctagacattctgcattggttaatttatggtcattcataaagacgtttgggtagaaagaaaatgggtaatggggaaaagtcatagagtggccaaacaagaaacaagtttagggttccagcagaacagggatgccttgatatatctgcctttggcaatgccgtgtgtacggagctgggattctgattgctcctattgtgatagtatgccactaatgctctgttggacggaatgactaactgaagtggtgagaaaactgcgagcctttcaggactgtttttaatgcttttttgacaaatcttttagaacaaatcttttgttcctttgcagggaacaaagtccttttgttttatggtagaggagttattcagggtcctgatcttcaattggcttagctttccctgatgccatttgtcacccgtaactcattggtgctccatctgccatagcccggaatccaggaacagtactcggtggtaaaaagttggagaagtagatacttgcaaatccagccttacgtgatctttcctggctttgataggttcagctttcatcctgaaaagttgtttaaacacttttaatttgtttcaagtgatgaaatgaatttatctcagaagaaaatttaaaaactttaaaatttattttatttggaagaaaatattttttaaatgattattagcattgtatctacaattatttatcttaaaaaggtaaatggccatctccattgaaacatactgcattaatttttactaaggacatcaaaatgctaaatatggttaggggaatttcttgacagttacatattattttgcctagatatgtgaacattaaaagcctattaaaggggacaaaaatatgtactttaatcagaatatctaattaaaatagacagaatagaaagaaataacattctcttgttttgtagatttataatgatctcattttcactatactaacattgttaataatttccaaagtagtatagaaaagcagtcttcaggaattttatcaagttaaaattgtgaatgataaaaagcatataacaaatttctactatacctcacaaaatgattgaactgttttcagacagttcagtatatgctaattgagtgtgactgaaagtatcagtcttctaaatttttgcattttcagaattttgacataatacattttaatacttttagacattggcaatgatttttaagaagcaaaaatgaatcataagtgctttccaaattaagtgaagtaattgtaaaatactcagctcagagcctagcacatagcaatttttgtgacaatcattgtttatgattgtgattgttacttctgactcctctcttcttgctgcactatttttgttccatttgtttgtagacaagtggcaatttccacaaactcaaagtgtgattacttttattgtatttttcctctagttcttggtgttttagaaatttctggaattatttccatatctgtcagcctaactcctcatctgagagcacacaatttttgtaatgcacatacagaggtgttgaagaacttgaacttgtctgatgccagtagtttattgctcattttgtcaagtatctaacggctttgagggccaagtgatgagctggatatggtcctgacctggagcagatcacacagagtgggatgggaagactggctccctgcgttgttagtgtgcctgtttgctgctggagtttggatctcaggattcctttgtttctgaagctagtcctaagatatcacaaaaacattattatgttttttgagaagattataactacaaaataacatgtatttttaaatgtttggcactaattcaagggctttccctttatttttatttattttagacttactagaatactttcagtgatctaaacatacataaagcaaaaagtaaaagtctctttcctacacttccttcactgcattgctcgggagaaactatttttgatattttggagtgaaagtttctggactgtttatacatgttggctcgatgtacatgttgaaaagataagttgcttggtgtgctcactgctgtggtggttgttttttacaaaatataagattatatcgtcctgcaacttactcattttaccagttaatttgtcatggctgtctttacatgtccttagtctttttcatggctgcataatactctactatgttgatgcatattggtctatttagtcattcctctgctgaggagtgctcagaagggctccaaattttatctgcttacaaatcatgttgaatcaacctcaaatgttggaagcttttgtccttggtcatctgtgcttgatttcaccatccactctgtggccatctgcataggctataggatacataggccacctgccctggttgcttgtttgctttcagggattattctaaaggttgtcatttgattttggataggcctgagctcagacaaaaaggaacaatttggttgtgtagggttttagggtaccagcatttttatagaagtttcttatttctacctgctcaaaatttaagatgcaccagatagcttggatggattttggctgtcatccttagatacttttatgttggccaagttctgagtttcagagctataagagtggtctgattcggaggttgcagtgagccgacatggtgccactgcactccagcctgagcaacagagtgagactccatctcaaaaaaaaacaaaaaaagaatgatctgattgtcaaatcttttttttttcattgtttattcttaaagtcaggacatcttttagaaaacactttgaaaatacatatgttgttttgtgattgtggaatatttttgtctttttatatttttgtacaggtacattgaaatttaatttgtgactcttacaaatggcataattaatcacagtcatagaaagccaaatacaaatatcctaaggttagcgtttcactggggtttgagtggtattcattaaggtgttcataaaattttatgttctaaagtcactatttacctagtagatatggtaacttatttttgtcatggctactggctatatctgagagtttaacatatgctagctgaaactgctgcatactttttaaattctgaactataattgcctagaatgaatgaaatcttttatttcaatagatatttttgcttgaaagatttcattttatatttatgaaatagtaacagattttattaaaggtgatgttaaattgttagaaatctaaagacaaaactgccatttctctttggtactatgataatttttcaacatattttaagcaataacctgctgttgattttaatagttttacctgccaacacagctggcatcctgctatgatatcattgctatacttttttatttaatattttacagagtgtatcatgcacagtgtggacaaccacattgaacaactattgagaatacgtactcattgtttgtgacattttacccttaaaatagagtgtggtcatcaaccagattttagagcacattaacgaaggaggtttacttttgcagggatttcttactgccaaatttttcctttgctatagctttcacatactgtttttgtgttttccttttccataaaacagtatttcttaaggccattgttatttatgtgcaaacaaatgaataaaaaaaactttcgctctttaacatgaagaaaaatattaacattgaaatatgaaatacagcaattcagtttataacacaaacgtatcttacaataatgggtatgcatttttaattgcatatatggaattacaaatctcatttttcttttctactgggattacaaaccatattgaaaaaaattttacagttcaaaaatcagatgactgacctgtcgaaagcgagttgtaacttattggcatacaattgaattactgatttttacactatttattgaatgtatataatttacttttattactgatttaaaactaccatcatatatataaaatagatattctttttaacatcaggtttttcttttctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccacatgccaattccagaagaaaataaattacttatcacaatatgtgaaagcatacactttatggaaatgtagtgcatgctttcatatactgtgataagtaaattttttttcattttttattctgaccacactttctgtttgttagttaatgatctaattaattttctagaacagatatcttaaaatattgaaagctgaaaaattttttatgggaagaaagtttggaatgagtctactaaattaactttgcttgtatttgctacgttaacagaaagaaaaatctttttaatttgaatctgttcccattccctgtttatatgacttgaggttatggaattggttgattgtggaattgatcttagattttcacagcattcacgttctaaaaatgaatctctcaaaagtcaataatttaaatttaataagtaattttgaaaattatttattttagttattcaaattatgctatggtattggaaatgctttagaattgtttaaaaacctatgtttttttaaaaaaaatgctcattaagatgccacatatcaggaaaaaattttatacacctctttctggcaagttttacctaaaacctgtattcaaatttatatcatagacatatataagataatttaaggtagtttcattcttcctaatttttaaattgaaaattaagtagccatattttaaatggaaggtgcatgtcttttaaattcagaatatcttcgcagtttgcaaacactttacttctctttactggtgtgaagatgctttaattgttaaaatatatgaatagggaattcctttaagagtatatggcttactacattgttatagaattatgatatatggataatggtaagtttttatttttagatgtttaattagtaaacaatgatttttaccaatgaaatatcttaagtgctaattgcaaaattaaaatatttgtaaattagatgaacccaatttaaacataaatgttttaaaaactagatcaaagtaatccataattatagtcaaaaacgaaattatttttacaatttatatgtagtcactgatagtaagaaaagcaaatatttgagttttgtagatttattgttttcctagttactatatcaattaaaatttaaaatgtactgattattattatataacatgagtacctagtatttattgtgtattttatacattgagtagcataatacaaagattagggcaatcatttcaagccagaggcaaaactggaaaaagaaactggattttctgacttatagttaatatatagtctactaaaccatttgaaaggatagtgactgttgctaattgaaactttgacagccttgttgtgttttgttcactgcttattgatatctcaaaagtttcaattgcatataattaaaaaaggaaaacaagtagaacatagttggaattagatactataactcctcttgtgaagtttgctttctgtaagtgtgcttttaaagtttgatctctgtaagttattggtagactgcaatttaatacaacatttttttagattggaatagaattagaaagataatctaatccagtgtctcttggtcttaaataatatgtggtcttatgttaatggaaaaatgtctctcaggccccaagaatacattagtgaatcctagtttgagaagtagtatattaagaattaaacatagtcactataactaacataaaatatcataaacataatatcaaaataagatcctgaaattatgtgataattgtcagttgcaaaaattgtcaatgagagtatcagaatataatcgtatttatataataatatgaagacaccaaaacaaagcatcttgtagcactctcagactcccaggaatgtgttcatagatcctcaggtgtccctagtctatattttgagaaatattgatctaaaccaactgcattctttttacagatgagtgtcatccagagtgtttgtgacttacccattttataaagacagtggaatatctgggattagacaggagtcttgaataaatgtaaagtgtgtgcacatgcactcttaattcaaaatcccctgccttccacgaggaagataatagaagttttggacccgttatacaatgttctgttgttcatggcaaaattattcaccagctaaccacagaatgacttgagacaatagtgtaatatttgatggaggaattatatttaatattttggataatttgagtttggatttattaatatgagaaatttgaaaggtacacagtgtttttgcttaattcagattttatttgcacaaatagaaagtatagaaaatgaattttagtaaaatttagtgagcatgatatccataaatgtttgcctgttatggcttttatctactgataaagaagattagaaaaaaaactagacacttgaaaaattttttttcattgataattttcccatataattttgagtaatctgagtaataaaatatacctttcagtaactctttcatgcagatattcaactatgcaatatcctgtattgagcttcctctctatggaaagccttgttccatattataagtgaaacctgtatcaaattaccagtgccttgggttgtttaaactgagatcacctaagtttgaggtacaactgctttcaccacttagcatgattcatatttctctatttcttttttggggtatattttttaaggttaaaaaagataaaacagggttaagatattgaaagccaactttctgggacagcagagaaaatgtacacggacaactctttcattgttatctgggaaaagatgttttaaatcgtggatgagaatgatgtataaatttgagtacttttgattaaaatatgaagttattgttggttcaacaaatgcaagttttatgtcaaaggaaatgaaaacaatgtttgctccacaggcgatttttgatagaagatatctggtagctttttaaaagctcatggttaatcctacaaaattgcttttaaaatattttaagagaatgagtattaatagtaaagttattgtttttaaatacattaaaatctgaaaacacctgaaaatatgaactatgctgttttattcaaaagtttaagttactacctatattaaaataaaaaatattgaagagaatacagcactatggagagtattcttttaagtttataattggtatttttagatagaaaaattatgctatataaaattaaatatcaaataaaggaacatttttataagaagtggtattggcattactatttaaagcttattttagtatacagatcaaatatgaaagaaatgaatataagatggagtcataatttatttacaaaactctagtttatagcagatggctctttcatcgtgcaaggaattcagtgcccacatcttaggtttgtttcattcctgctacttttttttttataagcctatttattttaccattttacagaaatttattgttaacagtcttagtttgaaataatggtaaactcacagaagtgattagaagactattttatattgattagacataatttttaaacttatttatttaaagtttcttcataaaacatatatatagagagaaataaatgattacaaaaataaaaaacagtgcatctaatttacgaagtgctttatatttctattggatttaatttggaaattaactggaaggcagagcaagctgaggtctggtatatttggccccactctggggaagatttcttggtcagttatttaaagcttcactctctcttcttatcttacattcccatctgttctcactttagggtatgggaactttttcattcttttcttttacttgacacatactataacttaaaatgcttcttttagggagtcatgaattgtgcaccgtaatttgtggaaaagtgcaatgactatagagtttagataattcattgttctttttattgtgtattttaagcaaagattttattgtttcagaaaattatatgaatgaattttatttgatgcttgtatgcttcagctttatgtaaccccaggtttttttaagaaagcctttagtgtgtaaaagtgttaacctcatctattttaatatcacccaaattaatttatatattctagaatgtaatgttcaacatagctattatttatttaaatattaagaccaaatagtttatggtattttggctggtttaaatagagtaaatttttttaaggattgtaaatcagcctttattattaatttccaacacacctgcataatgaaaaaacaaatcctgagtctgataagagttgtgtgataattttttttaaagttattgtttatttctcctgctttggattcagtgcttaaaaagagtgccagaaattttagggatgtggttggcttaagatttgagttttttttttttttttttaaatcacatggaagcaataagtctgcaataaagagtccaattggagaggatggtaagtttccataccattgttacatcctttctgtgcggtctcttttcttagcataagaactcagaaactgtggataccaacatatattttttaagattatcagattctaatagttcaaaggatttttatagggcctatacaagtcattatgtaaaagaaaacttttaataactttcaagttaaaggaatttttgcttttttcagtgtttcatgttagaatagtttatggagaaggattttttcttataaacttattactactaaatttccaagcactttgtttaaagatatcaatctgaaaagaggggaaaagatcctatagggtcttgaatttttaccattctggaaaacatgtttcattaaaattgccgtgctggtaaattgtcatcagagaaaactatcagattagtaatttgatgagtagtttactgcaattttataatctcagttaacaaaaaatttaccagtgatacaaaacctttcctaatagcaacagataaaacaatcaggagaagtatacttctgtactaaaagatggagccagagcatcagaaaaacagtttaatgtggagtgtttggatataggatggcattttaaaactgtagtttcttcctgaagcctgtttagtattctgtaaacagcttctgtgaccacagataggaaccaaagtctaaatcactctggggatatattgtggattgggctgcttcattactgtttgtagttaaatccatgttatactctgttggttcttctccttgccctaaccacacctggtctgcttccatgtcatcttctcctttgcttgtttagtttccacctccaaccctttccccattcttttttttgagagggagtctcgctctgtcgcccaggctggagtgcagtggcgcaatctcagctcactgcaacctccgcctgccgggttcaagcaattccctgcctcagcctcctgagtagctgggattacaggcacctgccaccctgcccagctaatgtttgtatttttagtaggcacgaggtttcaccatcttggccaggctggtcttgaactcctgaccttgtgatccaccgacctcggcctcccaaagtgcctttccccattctttcctgggacgtctcaaccatttgcatggttactcttgaaaccttcaaatttgaaactttcaaggtttgacctgttgagctttagacccaaaattccaacattatgcttattttggtagagataaaacatttgtgtaataaaatgattatctggaaaaatttgaatgtgaaacaatgagaaaaggtaggcatatgcacatggttatttgctagtttatggaaatcagcttatataaaaatgaactctatttctcttcaactttttctggaccttttaaactgtctcctttttgtttgtttgtttgttttttgttttgttttgtttttttgagacagagtcttgctctggctccatcacccaggctggagtgcagtggtgcgatctcggctcactgcaacctctgcctcccgggttcaagtgattctcctgcctcagcctcccaagtagctgtaattacaggtacctgctgccacgcccatctaattttttgtatttctagtagagacaggggtttcaccatgttggtcaggctggtctcgaactcctgacctcaagtgatcctcctgcctcttccttccaaagtgctgggattacaggcgtgagccgccagacccatcctaaactgtctccttatctttgtctccagctgttcacctctcgtctaattactatgtattattttcttaaaacacacatcaaatttcgtccattgtctgtttgaaagcatccaatggatcctcattgggtctagcaaaaaaatctttatgtcggcattcaagatcctgatctactcaaaccagtcttccagtgttatttctcacatccctttttgactccagtatgcagatcacactggcctactggctatttcctgaatgataagtatttcttataaccatcctttattaagtattctggggatagccttaatatgggcatttcatccaagaattggtgtccttgttttagagacacttagagtttattagaagtcgatgataaacaggtagttatagtacatgttagaatggaatattcagagaactataggattataaaatacgtgctcatttaacccatatgtggcagctaagttaactcatgaaggataagtatgaacttggtagtgaaggtaggtgggtatttcaggcagaatgaactatatgaataaggaattaggcaaaggatttgctattgaaggaattaaagtggttttgtgtgtttaaagactagcatgtgaggctgtagcgtaaggtaagcgttgacaagtaggtaagaattagatcctgaagaatcttaaatattaaggaatttgtttttatgtggaggaaatagatatgacagagtaaagccagctcacatagatgtaacttccagttttctcatgtaatatatataaaatatactttatggagttcttggcaaatagaaagtagtaggagctgaaaatattactataattatttaaggcaaaagaatataagtgaagaattttaagcaggagattaatatagatttaaaagttagaaaaactcctaggtagttgtgtagaggatacactggggaggagtgagagaggaagtgatggagaattgctaaaaagctagtcacagactgcaaaacaacattttggtcaacaatggaccacatagaagatgttggtcccatgagatcatagtggagcataaatagaaacctaataatatggtgcttgatgtgggcattgcagatcaagtatgggaaatgattgatatttaatgctgcttctgggatatttggttttccatgtgaaaaaatatgtatataaataaaaatatatatcatctaggtttgtgaaagtatagtctgtgatgtttgcacaaccacaaaattgcttaatgcgtttctcaaaatgtattcctgtccttgtgactcattactgtatgtgattaaactaggtgagatttgacggtcttctaaaccaaggacatgggagtaggttagagaaaggtgaatttttcagatagtaggagagagaatctgaatgaaagacttgctgactcacaggagtggggtggggattgaagtggatgagggagaggcagacagaagtcaagaataaagcatagcttggtttctaggttggatgatttttgaatagaggtgcagtttcactgagatggggaatatcattgaagaacaggtgtatgcgtgtgtgtgtgtgtgtgtgtgtataaggtaatgagtacattttagatttgtatctgaaatggggatgaaaatgtgtttctggagctcaggagagaatctaaggtgtaggaaatgggtaaggattcattctcttatactgatatactggtggctgagttcatgggtatagatagggtcacataggaagagataatcttaagaagggaaagtttctgaagaagaagctgcctgggttgaagaagaagccacaccaacatttaagagaaagaaaggaagttatgaagcagagtgagagggagtggcttcagaaaaggaagggagtaggagagagccattacatgagacaagtgcagaagagtttgacaatagcatatatggccaagaatattaaatgcttccagaatttaagacagctaaagactaatggtcctaccttgcatgtagcaactggaagacactggtgactgatgaaaacagaagggtggccaggaagccagacaacatttagactggtgagtgagtaagtagtgaagacttgaaccgatgaatatagactaccatttcaagaaacttgactttcaaggaaaggagaggaatgaagtagttagagctaggtttgatctcttaatgctattcacttggcatagaatgccatttatttcctcaatttgcagtcctccctggcagcctgcctgtcttctccctctcctccctgcccctctccctgtcctcattctctcccttcccctccaaaccatctagcagtcggtttttaaacatctatcaaacctgacctcttttttccattttcctaataaactctaaatgaacttagaaaaaaaaaagaaaaccactaaatctaaaaggaaaaggtagaaaatagcttatattgggatgggcaagacatttttaatcagaaaattaaaaggcagcagactcaatcatactgttacagagaaatatatttgcataaaatggaaatttttgtatggcaaaaacaagcatgattttaaaaacaatgacaaatgagaatatgttgtaacacatgacagagaactaacgtgtactctgttaagcattcttaaatgtcaatacggaaattaatagggcctttatttaaagggtcagaaacagattagttttataactatagccagcaaacatgaaaaaatatgccacttactattgataaaatgctaattttaaaaatgtaatatcgtttgttacttataagagtgggactgcttaaaaatgaattttattttctgctgagatgatgtagaatgtgaatgtattaatagaaattgattcacgtttccaggatatcatattgagaatgtgtatcgagactcttcaaagtgtagatttcctttgattcaagaattctaggaatcctcacttaggagttaaacacaaaaatatgtattcatctcagtgttgttcgttcgataggaaaatatcggacacattattaatgacaacaacaggaatatattttaataagttatgatttgtccacttgatgaatgttatggatttatcaaaatcattaaaagagtagttgataacattgtaatatttgcatgaataaaatagtaaatgaaaactcacctgtatgcaaacctacaggtactttacttgctcaatgttgtgaaaagaaaaaagaaaaaaactttatatatacatacatctaggcataggaaaagaaacttgcactataagtcttttattgatttgtattttctaattgtttcttcatttttatgtacatacatgtcacttttttaataattaaaagctttattatatgtagatgtttctctcacatgacatggttattcttttaaatcttcctagttgttttaaattaaaaaacccattttgcttataaagttgttttgcaaagatttcatattacttattttgacataattcctttatcatgtacatttgagttttgggatttaccattcatagtgatggtggttacttactcagaattgtcatgtgggatgattttaaaaccaatgccacctcaccgcataagatttggtttttctgcaggttagtgtctgtcttctacatgtatggcatattttgattcattgctcttattacagaagtgaaagcagcattgtattggggtattcagattatttaatttttctgtattaatcagtaatgatactgaaactgacattactagcatgtaattgatactaacattgggttcactgcttattttccatccctctttttggtattgaatttatcatgaattgtcatcattctttttgaagtctttctggatttaagccagtcagaaaaaagatcatatttcatctccctgagtaataagtgccccagtttctctcatgcaattcttggtatttctgtagtcataagtagtcccccttgaattcaaaggtgcattcataccaagctcctctactctttctctgttgtcaccccagtaagctaaggaagacatttatatttacatatttaccaatgaagtttcgtagactgaatggactattaattagtaaaatagattctctgaaggaaagcattactttatttaaaaagttaatggtgatttctatgacttggtccctttttgttgttttttaataccttaaaagttgtagtttccattcattgcattgatccttgaaaatatggctgtatcttcaaagaaaattatagtggatttaaaatattttcttatttggtatgaaatgattgtatttcagtatgtatattttaaaatgtacagccttatcttcaaaattttctaactacaataaggttatttaaaattttatacatgaaagacagcagataatgtatccataacctggctgattctcttggccaccttgtacaacattttaggcaaaaatgaagacacatattcaatttgccaagaaatgttagccatgttttgtcagcattgtattcacaatcagtaacaggatgggtctgcctcctggagacagaactaaatttctcattttgtcatgccctttgtaggcaataatgttggtgatgttgatagctcattttggtttggtaatttagggtaattaaacttacagatcaactcagtttgtgttttgttatgagggccattatctattttcatgaatgagttcacagctcactaaaatatagtcgagtttaaaatagacattaaaatagagattcactactgctgatgcattttctcctcaatttgaagttaaacacttgtgaaaattaagacaagttaaaatcagcacttactgcaaaaacaagaatttgaaaatgaaggttaaaagcagaaatcatctagttgataattgttttgatttttcaaatctatcaatattaatgtgagtctttaagatatctgaaaatttccatttgattggaaaatgttggatgtttgatcattttctttcaagttaacttaaaaagtgactttatttttgcttcttgattcatttgaagagacataacttttttgttttaatcctttagaggatcagataatgacatttgctgtttaagacagtttatatttcagatggcacaaagagtctatttgtctttatcaaaattattagctgaaaaggatataattcatgactgttctttaaaggggatctaaatatttatgtttttaaaaatgccttaaggtgactaacatttctaaacctatatttgtatcatccacatttgtaattgtgccattgcttaaaacaagtcctcattgtgtcctgtcttttgacaggattagtttgctctcttaattgtaacacattttcatttcttttctggattgatttaaattctgggcttcaaaaagcagtagcataaaatagtcaccatgcctgtattattagctgctttcagaaccactcagacaatgttttctctgagatggcttgtatttttaagtgttgcatttttcttcttgttctgctagtcttttttctaatagcaatggttaactctaatttatattagcagttaaaaaaactgaaacttaatcttgccttttcagctcattactgaagaatctcctgcctctgcactctgacacaaaatttatactttattttttaaccatgaacttttctgggcatagagttctacctaagtgtacatagctgaacaacttgagtgtattttgtgagtaatattccaacatcgcacaattctaaattttattaaaaccagcttttctgtggcagtcccaatacacagttcaagtacattaaaataatgaagtactgcataaatgttgataaaatagtcttctaatatgatggaatgcctaattatgtattctgttatcaatttacctaataaattaaatgcagtttcaattttaataaaacccgtgtactttataaaaataggacctttactaacctatatctatactgagtcatgggagcaacagtagcatgggtaaatccttctggtagtaagcatggatactcttatatctgttcagagaaccacagtatcttttctcctttctgcctgccctcttgctgctctttctgcctttaaaaaacaaacaaacaaacaactttccgggcagtgtcctccatgccagtcttgtgaacatgtggacctttgcagcaaaactataatattttttgtcaccatgggtaaactaagcattattttgggtagtttgtgcttatgaaggctttctccatcctagtagactaaaatagaagtatcctgtaatattagatgaaagtaagggaatgaggtttgatgtaggcaaatctttttttcctcccttggggttgatcaaagatgatactcattaaaaatactatgaaattgcttaataccattcgaaaagcatttgtaaagtggatcttctgtcagtataagggataagtgtgtctctgtgtgtgtgtgtatatgtgtgtgtgtagtaagagatgttgattctccctacattaacttttcaacctgaagaatatatgaattaactttttaaattgatacttttttaaacagtgtaattaaatgaggtgtgatatatgaattttctgcttatgctgttaattttctccaaggatatcatagctaactgtagctttactgttgctactagaagatatttgggcgatcagcacaatacataattaagaaagagattcttcaaatataaactaaggaaaaaaacaagtgggaattaggaaaaacatttaaaaacaatttctccttagagtaaacccaattttaatttttctttttagaacaaatgtcttattttgaaatgctggttaggctatttgaagagatttgctaagtacttaaacattcatttgtatgacttttcttactacttgccttgttactcaaaattgggacaaaatattttgtttattgatgaagacacatttagttaataatataaagcagcattatctttaacatcaacttcacattatatgttaaaagatttctttagaaccagaggcttggctcactgactaccagctattgaattattttccttagggacaaactcttagccttaagttaatgtcttctgagagggtagaattccttattatacacatatggataattgctttgagttaacggggaggatagatgggcttctcaggtactggttcattgaaagttttttgcctttcaactatgaaaccagcagtacagcatttttaaattgataagtgtttcatagacagagtctgaagccctgtgttattaatgaaggttttcattagtaaaagtttatttttttgtgtcacagaagtagagtatgattacttatatttatctttttatgacatatacaaggcaagcatttaagggtgattttattacatttgcattgttgttcatcagtctttggtcatctgtctatcaagtagagctggcatctatattacaataattttctttcaaaaagaaatgttcagaaatatacagtaagtgaccatagtttcagcttctatgtcaggccaaagggaggtgaactggtggggagtgagtagattagacccacttgttgttgatccaactgttaaaaacattgttctctttcccaccaagttcctaaattcttatttacttgcctaaacaggaagcttgcatagagtcagagagatcccaagctggtaatggaataatgatgaccatatactttgtcttctgtagtgggacaacagacataaagtgaggttgtttgatgtaaaccaggatgttcacttacatagttttcatgctacttaatgggaatatgtcagccaccatagtatgcaattaaaatttaagagattagtgataatggagttaggactatatagcaatttttctaaatcaaatttaggcctcttaatgtctgagaactttaaaaaagatcaagaatataaatgctattccttggttcagtgatttttttttttaatgtaatgttgatacaggatttttgctcttttagctcagctaggtccaggttcttgtctcccaaccaggaaaaattaggcgtgcagacaccagagagtgagtggaacagaatttattaagcaaaaggaaagttctcagcaaagagatgggtcctgtaaagcaggttcctggttgttcccttccagttttgaatacaagggcttttatataaaagcttgatggagctggattccctgtttgtataaggtgggaattcctggtggctccaccccattccccctggacgcatgtgggcacttagtctgctgagggcatgtttagacaagccccctgtgcacgttcccttatctgcacaaaacatgggtcagaggtttgcctgggacccttcccttactttctgcctaaagcaagctggttaactcctttcaatgtcaaagaaaaatttgaggtttctttgccagtagctactgcttcttgttcacttctataatttattcttagttagtgacaaactactcgagaatcattgaatgacttacaatttgttgtgttggaaattaaataatcctcagtagttcgataatatcaatgattcctaaataacttaaaagctttttttttccaaattgggtgttagtagttagtattacgcacaaaatgaagataaaatataattatatgatttagtatgccttttactttttagctgctcgagtaagtgaaaaaatgatcctttctattaataacaacttttaaagttttacaagcatggtgttttcaaataattgctaaaggggcaaattacactgttatttaatagtgaattaaggatctagggagaattgttaagcatttattatttcagtaaacttcactttcattaaatcatattgttaaaggcctgaaattctataaaaatttgtttaatggcatactgacatgttgttattcatcaaccttagggtctacgtttttgaaaaatatgatgagaaaagcccatttggcaagatcaggatctcatagaaaacagggatttagaagcaaataaatatgacattaaatatacttgaaatgtatatttaaaataaggacatgacttcctaaagaaactggaataatgagtatttgccaactgtgtagatacccctcccctgagtgatcttctgttcataaaataatgctgcaatatgtgattgcctaagccgactgtactttgtcttaaggtttttaaactaacttgtattataattaaagttagtcatatatgtatatataaatatataccatatatatgtgtatttttttttcttaaatactgtgaaaatgcccagccttttcagatattactctgagagttaagggttgattttcattgcctggtctttgttcatgtgtggaatggctgagtaagtaacacatagtattgggaagcttaggggcagggatggaggggtagggagcattaatggttaagtgagcattttgtttaaggggacagagcatatctgtgtgtatataaatagatgtcacattttaaaattctagtaaacacagagctgttttctcaaaacatagatttgctaagccctcattgagggattattgaatggccaattcatgtatatctagaacttactcatatatttccttgctttttgtgaggaaagagtagttcttctaattgttctttttatggttctggtaaggcattttagacagtatggttgcatataaaatttcattgcagaatctaaaatgcgagctaaaaatagccattttaaaattgattccatgagtactttacgggttatacatagtacattgttgaacttctcccttctttgaaatagtgagactgccaagtatatcaggagatgaagtgattatcaaactgcactgattaatagcaaaaagatcaaaggagacataaggttaagatggctgactagatgcagccaggaagtgcagctcccactgagagagaccaaattttagagtaaaccactgtaatctgggcagatcttcggagagaaaatgctcagattgggttgagaggcaatgttaaaatgaagggtgaagagtaaggaagctggcagccctgtgctgggtacctgaataccagggctagttcccagccccgaatggctcttgggaaaggggtgaatgaggaactgagggaaagctcactctcaccgccagcctctgggatcctagatcctagttacagaactccgtgtctcccctggatgtgtgagctgacaggggcatctccctggggagcaggcagagacaggccgttggacagcatggagcccaaaagttttcgtgcactggggagctccagcagagagcagccatagagctgctctgtggggagggctcttcatccctttctgggaggtgtggaccccagctgaccttcaagctaggagagagtgaaaccagcttccctgtgggactagagcacatctattctgcaaggcttcctgcctgctggccccacccagggtcacgcttagccaccctgtaggagtgagtgcacagcacagcccctgcagcacagcctgagtatgttgctctacctgagtactttcctagtgacttggaagcacattggatcctcccagtacagctggaatgccaacctaatccacaggctgtcccagtgcccccagggctgcttcatgcagcattttgggagtaagtagccaagatctgtggccagcactcaagtcaggtagaagggggcaagatcttcaggttactgggctggggtgggaggggagcagggtatgcctacctccacagagttgatccagagatagtgaggcatatcttcctcctgcagcccctgatcaagaaggccccagagcctgaaacacctaacaaaagaaacatgggcacagcatcagtgactggaaggaggctcccccaaggcccaggagcagacctggtgagggggccatgtctctcccccgcccactgcggagcatgcctgggaacatgaggaagaacgaaagagcctcatggtggggtattaacttacctaattaatggccattactcctaagcaccatctaatggattgcattgagactacagcaccaaaaatttatcccactactatatgctcctttgaaatccagcacaagaatttgttaccagaaagtggtcccaattcagaccccaagagagggtttttggatctcttgcaagaaagaattcaagatgagtccataaattgaaaaagcaagtttattaagaaagtaaaggaataaaagaataaaagaatggctactccatagacagagcagccccaagggctggtggttgcccatttttatagttatttcttgattatatgctaaacaagggatggattatttatgcctcccctttttagaacacataggggtaacttgttgacattgtatggcacttgtaaactgtcatggtgctggtgagagtgtagcagtcaggatgacctgaggtcactctcattgccatcttggttttggtgggtcttagccagcttctttactgcagcctgtataatcagcaaggtctttataatctgtaccttgtgccaacctcctatctcatcctgtgaattggaatgcctaactgtctgggaatgcagtccagtaggtctcagccttattttacccagcctttattcaagatggagttgctctggttcaaacgcctttgacatttctcccctcccttaaaagaacccttaatcttaagggttacagagggatgaagatcaatcttctgtaacttcttgatgctgaaaagaagcgatgacattcctctctaattgtcagggtgtcttgcattcagggtagagaggagctcagtcagaaatcatcggtatgtcaagggccatttataattcttgagttctgacagaatgtgatatctggaatattaataagtatttaagaaaacattcagtaagactattctgcattcctgcacaaagagtacaacagcaatatatttcacaatggtaaagcaagatcagcaaaattatcccaagtaaactaaataagaaggttttccatgaactcggcaactgctggaaccaagctgatatggggttactagctgattccactatgtgtccagaattagaatattgatctaatttctacattatccatcccttttgtttttttttctgagtagcagccagagatcactggttggttcacaggagtaagcagggttagtctaaattgtaggaaaaacctcaaaaataactgatgagactagaatttaataacaagtgtaccacagttcttgaaacataatttttttcgtctcttcagttttatatttttactaaagacatagtggtaagaccaagttgttttattatacttggcctatttgtataaagtgcagcaagaataattatttttcacataagctgtttttaaattggctttgatggaactctgttccatgaaaggaatcttagataagacttcttaaaagctgagccctgccatgggtttgtaccctcaaggacctaggagttgggtaaattcccctccttttatggtctgaagataacttggggctcctgggcctgtcatacagtgacattttgttacttaccacaggtcaggaaccctgtacaggaactgtgtagacaaggtatgaggccagttttcccaagggtcttttattggctctataagttaagtttgattcctcaaaggaaagcacaccatttcagttaaagccttggtgtattagtctattctcacactgctgataaagacatacctgatattgggtaatttataaaggaaaggggtttagttgactcacagttccacatggctggagagacctcacaatcatgatggaagagcaggggaggtcttacaaggcagcaagcaaaagagaacatgtgtagggaaactcctctttataaaaccatcagatcgcgtgagacttattcactgtcacgtgaacagcctggggaagacccatccccatgattcagttacctcccaccgggtccctcccatgacgtgggaattatggaacctacaattcaagatgagatttgagtgggggcacagccaaaccatatcattccaccccagcccctcccaaataccatgtcctcacatttcaaaaccaatcatcccttcccagcagccccccaaagtcttaactcatttcagcattaactaaaaagtccacagtccaaagtctcatccaagacaaggcaagtcccttacacctgtgagcctgtaaaatcaaaagcaagttagttacttcctagatacagtggagctacaggcattgagtaaatacactcgttccaaacagaagttggccaaaacagaagggctacaatgcccatacaagactgaaatctagcgaggcagtcaaatcttaaagctccaaaatgatcttctttgactccatgtctcacatccaggtcaggctaatgcaagaggtgggttcccatggtcttgggcagagctgcccctgtggctttgcagggtacagcccctctcctggccactttctcaggctggcattgagtgtctgtggcttttccaggtgcacagtggaagctgtcagtatatctaccattttggggtcgagaggacggtggccctcttcgcacgctccactagggagcaccccagtggggactctgtatggggactcccatgttacattttccttccacactgacctagcacagtttctcccggagggttctacctctgcagcacacctctgcctggacatccagatatttccacacatcctctgaaatctaagcctaggttcccaaactgcaattcttgatgtttctgcacctgcaggcttaacactacgtggaagctgccatggcttgaggcttgcaccctctaaagccacagcccaagctgtgccttggccccttttagccacagctggagtggctagaatgcagggcatcaagtccctagactgcacacagcaggggctggcctggcccaggaaaccattttttgctcctaggcctctaggcctgtgatggaaggggccaccgtgaaggtctctgacatgccctggagacattttcccattgtcttggtggttaacattgggctccttattattcaaatttctgcagctggcttgaatttctccccaggaaatgggtttttcttttctattgcattgtcagtctgcaaattttccaaacttttatgctctgtttcccttttaaaactgaatgcttttaacagcacccaagtcacctcttgaatgctttgctgcttagaaatttcttccaccagataccctaaatcatctccctcatgttcaaaattccacaaatctctagggcaggagcaaaataccaccagtctccttgtataacaagagtaacgtttacaccatttcccaacaagttcttcatctctatctgagaccacctcagcctggaccttattgtccatatcactatccgcattttggtcaaagccattcaacaagtctctaggaagtttcaaactttcccacattttcctgtcttcttctgagccctccaaactgttccaacctctgcctattacccaattccaaagtcagttccacattttcacatagcatctcactttactggtgttacaggaagtcagggaccccgaatggagggaccggctggagctgcggcagaggaacataaattgtgaagatttcatggacatttatcggttctcaaataatacttttataatttcttatgcctatctttactttaatctcttaatcctgttatcttcataagctgaggatatacttcacctcaggaccatggtgataattgtgttaactgtacaaattgattgtaaaacatgtgtttgaacaatatgaaatcagtgcaccttgaaaaagaacagaataacagtgacttttagggaacaagggaagacaaccgttaggtctgaccgcctgtggggttggacaaaaagagccatatttttcttcttgcagagagcctataaaccgatgtgcaagtaggagacatatcgctaaattattttcctagcaaggaatatttatatcaatgccctgggaaaggaatgcattcctgggggaggtctataaacgaccactctgggagtgtctgtcttatgtgcttgagataaggactgagatacaccctggtctcctgcagtaccctcagacttattagggtggggaagaactccgctctggtaaatttgtggtcagaccggttctctgctctcaaaccctgttttctgttgtttaagatgtttatcaagacaacacatgcatcactgaacatagacccttatcagtagttctccttttgccctttggcttgtgacctttattggacccttatcagtggttctgctttttccttttgtcctgttccctcagaagcatgtgatctttgttctgctttttgccttttaaagcctgtgatctttgtacctactcccagttttacaccccctccccttttgaaacccttaataaaacacttgctggtttgaggctcaggtgggcatcacagtcctaccgatatgtgatgtcacccccagcagcccagctgtaaaattcctctctttatactgtctctctttatttctcagctggccagaacttatggaaaatagaaagaactacattgatatattgggggtgggttccctcgatatactggtatcaatttactgtattagtgtgttctcatacttccgataaagacatacctgaaactgggtaatttataaggataaaggatataatggacttacacttccacatggctggggaggcctcataatcatggcagaagacaaaggaggagcaaagtcacatctcgtgtggtggcagacaagagagagtgtgtacaggggatctcccctttataaaaccgtcagatctcatgatacttactcactatcacagaacagcatggaaaagacatgcccccatgattcacttacctcccaccggatctctcccatgacatatgggaattatgggagctacagttcaagatgagatttgagtggtgacacagccaaatcgtattacttggtaaaataaccagtttctccaattgtgtcctgttaccagaaaaaaaaaaaaaaaagattcttattgcacttacactaataagtatattgtcataagttaagaatactcacaactagtttgcaaatttggagaaagtaggtagaaacaaatacgctccaaattttgttcaggggaactcctctttataaaaccatcagatcttgtgagacttattcactatcatgtgaatggtccagggaagacccacccccatgattcagttacctcccaccggatccctcctatgacacgtgggaattatggaacctacagttcaagatgagatttgagtgggggcacagccaaaccagtaatgtaaaatacaggagtatactttactcaattgttaaaagctattaatacctcaaaagtttccttgatgctgcaaaacaaaacaaaggatcagcaatgtttgaagcaaagtcaacaagattactttagtgttctattagttcagttcatgcagttaactcctgttctgcttgatatttatgaacatttcacctgtctatgagagtcctgaaagttttttacctctattctaatgttacaatcaccatagttatcagaaacctgcatttaagtgcacctgtcaaagtcttatagctgattataaaccaccttttgaagaggattaaaacaagacaacaattgtctgtgaatgataaaatgtcttaggaaaaaaccacagtcaaaaacacaattgacaaggaaatttggttacctctgtggcatacagtgattttatgtagccattataattattaataacatacagttattcatattggaattgtaggagtttcccataagtttggaacacatatgaaacatatttatacaaatacagtccaaagacaacatcactcctgtatgattttaatatatcaaataagccaaattttacctttacattagtgtgctattattgataaaccaaatttttaataaaaccttataaacaaatctgtttaaccttaattaatttgaccataaggtaatagtctcataaaccttttataaccctttacatttttttttaatgagcagatcagtgctatgaaaaacctgttgtgcttttattccaatgtttaatttatggaaaaactgaatgatgcccttttaactttagccaatatgttcacacacagaatctcttttacaattaatttttcacaaaccttccacaactggcttaaaccttcagctttattttatctaacttaaaacaattatttaaccttttaatcttagggaaaaaaatcctcattcccctgccttcttataatcttttaccaaaaaacacatttcactttctttacacagcttgcatgtaaaactgtttttagtagtctcaattatgtgttatagcgttaactcttagtgacttttacttttgatgaaaaccttggtaagagattttaattaggtactaggtgtggagtctaggacaatggacagaagtgcagataagggcgactgtttccagcatagcaagggggcatggctttccacatgtcccaggtcttatgtaatacacaatgatccaatgtaggtaaattgaacagttttccaaagtcaaagaagcagtttatgaccctaaactacttagaaaacctaatatctgacctgcctaatttggaccaaatgtttaaattttgaagatatctttattttgtcaataatttttgaaactgccttcatttccaaaagattactaaagtcatatgaagtaaatgacattacacattttacttttctgacaaactatttgatttaagcacttactatttttaaactaatcaaagttttttcatatataaacatcgcacacacacacaccatgtacaaatacatagagagacagaaggtccagtagttgtaagatttttcatttccagtttttaagtttctctttaaagcatgccttttccagggtctaataagcagacacagctggaaagcaaaactgatttccaaaaattaagggtcccatttttattaccagatcctggatctcaaaaagatggaattaaccagcctcccatgggaatcttacctctcagtggagagtgaggacatttccataacttgtaggtggccaagaccatgtttctctgatccatacttgcagagatgagtatctcccataactgccattagctagccccaaaagtatatttcctacctagttattacataccaaagctctctcataatgtgaagcaatttctgatgcccccagtgtcaaaaatgtcacacaatgcagtgcaaaacagaacagagccttaaattttgagagggatttatccacttccaattcctgggcttttatgagaaaaacagaggattttttttttcccccaaaatagggtctgtgctgcctcctctgtttttttcaaggagtcccaggctgttagagcttgaatatatgcttttaattaagctgatgtttaactatagcactctttaaaaaatgcccttttaaatttctttctttttttttcctagacagagtctcactctgtcaccctggctggagtgcagtgacacaatctctgctcactgcaacctctgcctcctgtgttcaagtgattctcataccttagcctctcaagtagctgggattacatgcatgtaccaccatgcctggctaactttagtatttgtggtagagacagggttttgccatgttggccaggctggtcacacctggcctcaagtgatccacttgcctcggcctcccaaaatgctgggattacaggcattagccaccatgcctgccccttttaaatttcttattacctgattttagccataccaagtggccaatatgtctggcttttgggctttaccaaatgtaacctccaagtgctcagagaatggaaaaattcaagttttgtggaggagaggagaattaacaaatggtaaaggtagaacagatatcaaatcagaaaggactcattccctaagccaggccaccattgtgatgatggagaccaaaagaaagtactgccacatggttacaggttcatgttcccaaggacatttctcaatgtgtggtctctgggcaagatggtcaccctaagtaacagagaagattggaaaaggaaaggagagagaggaaagcgttgcctgtggcagggtggggaagatgaagagttcagtgaggccaaagaaagacccactcattgcagccaacgctgaatcagaagttcagtctgctgtttgttggtcatgaaaggatcttttctggcagtcccatcagctcttaagtttccccctttagggagagaaaaagcgccccatgtcctatggtcccgtatatgcctaattctgtcacccatagccgtcaacaaagattgcaaggcagattaatccaaagagaataccagttaacatcccatagtgccaaacccattcttaactgagaggtactttactgaaagggtctttctaactccctaaattttaggaaggactctaaccttcctaagttgagcctcaaaccaagtttgctcaagcatccttgccttttattaagaggggcctttaacccactctgtcttaggagagactcttaattcccctaaattgagtctttaacccaatcccattctttacccaggcaaatgcaccccacttacccaaaagtcagccagttggtgtgtgtgtgcagatgattttcctttgggtcggagggtctcctcaatatggtcccttctgtgtttggccagaaagatgttaccagacgccaccacttacctcaagttagcctttggttcgggggtttcctcagtatttttccatctgggtcaccagaaagatgttactggaagggggtcccaatccagaccccaagagaggggttcttggatctcgtgcaagaaagaatttgaggtgagtccataaagtgaaagcaagtttattaagaaagtaaactttatagaaaagaaattccaaccaagaatttcatatcctgccaaactaagctttataagtgaaggagaaacaaaatcttcctcagacaagcaattgttgagggaatacatttcatctagaccagtcttaaagacatccttaaagagtgctaaacacggaatcaaaagaacaaaacctgctacaacgaaaacatataagtatataacccacagccactataaatcaactacacaatcaattttacataacagatagctaacaacatggggaaaaggttaaaataatacataccaaccttgaatgtaaatgggctaaattccacacttaaaagagacacagtggcaggcttgatataaagacaagacgaaagcatctgttgtcttcagtagacccatatcacatgtaatgacatagacagactcaaagaaaaggatggagaaagacctatcatgcaaacggaaaacaaaagaggaacaagagccactagtcttttttttttttttaaagacaggaccatattcccactgcccagactggagcgtagcgctatgatctcagcccactgcatccttgacttccagagcccaggtgatcctcccacctcagcctcccaaatagctgggaccacaggccgtgccaccatgcccagctaattttagttgtttttagtagagtcagggcttcaccatgttgcccaggcttgtctcaaaatcctgggctcaagcgatccacacatctcagcctctcaaagtgctgggattacagatgtgaaccaccatacctgggcaggagccactattcttatatcagtaaaacagactttaagtcaataaaaggaaggacaatgaagggcattacataatgataaagggtacaatccaataaaaagccataactgtcctaaatgtatacatacccaacattgaagcagccagtttcataaaacagtttcttcttggcctatgaaaagacttcgacaaccacacagtaatagtaggagacttcaacaagccactgacagtgttagaaatatcactgaggcagaaaactaataaactctggatgttaactcaacatgtgaccaactggaccaaatggacatctacagaacactccatccaactactgcagaatatatattattttcatgtgcatgtgggacatagattctaagagcaaccacatgctcagtcataaggcaaatcttaataaatttaaaaacaaatgaaatcataccaagcatattctcagaccacagtgcaataaaaatataaatcaatatcaagaagagctctcaaagctacacaaatacaattaaacaatttgctcctgaataactacacaaaataaattaaacaatttgctcctgaataactcctgggtgaacatagaaattgtcagaaataaaaaaaattagaaattaatgaaaatagggacacaatttaccaaaatctctaggatgcagccaaagcagtgttaagagaaaagtttatagccctaaaaggctttcattaagaagttagaaaggtttcgaattaacaatctaacttttcacctaaaggaactaggaaggaaaaaaaaagaacaaccctaaagctagcagaggaaaataaataacaaaaattagagaacttaatgagattgagatgcaaaaatccatacaaaagatcaatgaaaccaagaggtcgttcttcaaaaaaacaataagattgacagaacactagctagattaacaaagaataaaatcagagaagatccaaataagtacaattcgagtttataaagatgacataacagctgatcccacagagatcctcatagaatactgtggacaattctgtgcacacaaactagaaaatctacaggaaattgtcaaatccctggaaacatacaacctccaaagattgaaccaagaagagagtgaacacttggaacagaccaataacaagttaggaaattgaatcattaagcgccatgaaccagatagattcacagtcaaattctaccagacatacaaagaactggtaccaatcctactgaaactctgcttaaaaatcaaggagaaggggcttctccctaactaattctacaaagacagcatcagcctgataccaaaatctcgcagagacacaacaacaaaagaacacttcaagccaatgaacatagatgcaaaaatcctcaacagaatactagcaaaccgaattcagtagcacatcaaaaagttaatacactatgatcaaataggctttattcctgggatacaaggctggttcaatgtaagcaaatcaataaatgtcattcaccacacaaacagaactaaaagaattactgggataatctactgattacctcagtagatgcaaaaaaaacttttgataaaattcatatctctttatgataaccctcaataggctaggcattgaaggaacatacctcaaaacaataaaagccatctatgacaaacccacagctaacatcatactgaatgagcaaaagctggaaccattccacttgagaaccggaacaagacaaggatacccactctcaccaatcctattcaagatagtactggaagtcctggccagagcaatcaggcaagagaaagaaataaaaggcattcaaataagaaatgaagaaatcaaactggctctcttcattaaaaatatgattttatacttagaaaaccctacagactctgccaaaaggctactagaactgataaacaattttagcaaggtttcaggatacaaaatcaatgtacaaaaatcagtagcatttctatatacagtaatgtctaattgaaatatatactaaattatttttaaaacaacttttagattttttcttacaaatttttgcaatgatgttgtgaggatgctttccttttgcaaaaggcttattacataccttttccttttgcaaaatgtttagttctgtaatcatgacataatcaacatgagacatgttagaggattggatgttcaaaatgctgactttcctggcaaaacctatgttgtcaagtaggtgataaaagtgttttctaataaaacaagcacagtgcttatttgttatatgtcagtgcaaaccaaatgagcttgagttttctagctggtcgaattttaaacacaacaaccagttatttctatcgattgcacttatccatttgtttagctttaaaccatattctggatttgttgttttgtcccattacactgttaaaggaaaaagagaaaatattccatgaagttttgctgagacaaaattttggaataaaatgaaatatgagctatgctgtaaaacaaacattgcaatatgaacatatggaatgaagcagctttattggaaaactcagatctgtggaggtggcagcactcatgtttgagattcacaaatgttagtgttagcttaagtgggataatgatgcttaaaaaaagagcagaatttccagtgtgcacagagaaaaatactgataagacttgatttattaaaagtaggaagtaaagtcaagtcatatacagaaaagtcctcacctattacctgaactcaaagggtaattcttttgtattgtatggcttcagttagttggatttacgtaatcttttattttttaatttagcattaaatgctttatatatatatatttattatgccttaagttctaggaagcggatttgcataatcttatgtcagtatccactggcatcgaggtggagccactctaataaatcctgcaggctagatggagaaagaaagttttttaatttatttaacgagttaagttcacttacatattgtaactgaataagtctggcaaaaatagatgacagacaaaagaaccttagagaacatccaacacagtttcccatctcatctgctttgatctctcctgatctcctttcaacttcttcaaatgcctgggaacatgcccacaccaacctaaacatggatggacacaagcttctgcataagagccagaaaggatactgacacaattgaaattgagcatttggcgttcatctatgtcaagcagaaatagattataaatccgtgtgaaattaaaaatagataagtacataaaatccatgcgtgtgtgtgtgtgtgtgatctgcttcagcaactcatcatttcttcctttaaacttctgtaaagagaggtagggcacagcaaatagacctaaggaacttgagttaaaaatttacaaagcatcactttatgacacctctaattaactccctctcctttgaaagaatggagaccactagagaagtggtctgttaccttaaatgagtcatttcaattctgagtgaggcatgaatttacttaatgtcatagctttaggaaatttgatcaccatattcctttaagttattagtaatttaatagggaaaaagtaagacatggaatgaaatgaaagattattttatgtgaatttttgtgaacagaggaatattagaaagaaatagggtttaggaaatagtctataatttgctgaagataagtctatggtagtaagtgattaattcagaagtagttacatcctgataaaatcaaatactttatgcttgtgaaaattcgaacacagtataagaaagtagacatgtgagcaatactgtggtatttttgtacattcttcagttggaagattcttcacttgtagtaggcttttggcagatctgggtcattgttatcctaggcagagttggggtggggtagagattggttaataccttttgccattgctacattttggattttgaatttctgaatctggctaagtttgcaatacatttttattctctaatgtttcctaaaaattctgactttcctagcaaagtgaaaactgttaaaggtgactcaagaagaaaaagaaaactcaaatcttcctatagcatgagagaaactgaaccattagcttatttttccttaatgatagcactaggctcaattgattttattggtaagttttactggagctcaatgttttatacacagtgttctagaagattgatgagaaaacctagcccatctcattttataaattttgtgtaacttcaaaaccagacaaggataattaaagaacacaaaactgtaaatcaatctcactcagaaacataggtgcaaagtttttatagcaaactgaatccagaagttttccagaccaagttgggtttattccaggaatggcagattgacctaacattagacattgtattaatataatttattacattgattgactaaaaagaaaactataccatttcagtgcatgcagaaagagcatttagtaacattaagtaccagcttatcattaaaagaagaaattagaaacttcctttacctgataaaggttatctaccaaaaacctgtaacaaccactatatttaatggtaaaatattggaagcattagctttaatatcagaaaccatgaaacctactgaaactaattatatttattgttgtactcgatgtcctaggacaggaggtaaaagaaataaaaatgccgttcattgacagaatatgattttctacatagaaaatctaatttaggccatatatactgcttattagaattaattggagtttaacaatgttgctatagataaacatcaatacaaattgaaaataaaaactttaaaaaacatcagtatctatggtagtgactataggtatctggggataatctttaaaaaatcatttgagacctttatggaaaaattatgacttaaaataattaacattttttaaaaaagactatgttcacagatagattcattgcaatataagttgttgcttaatggatctctagagtcagtccaatttctaagaaaaccaagtgggtttttttttgaaaaattatgacttaattaaaaaaaatttaaaaatgttttttaaaagactgtattcatagctagagacatttattgcaatttaagttgttatttaatggctctctagggtctgtccaagttataacaaaatcaagctctctttttttcttgaaatgtgacaaattgattctaaaatgttgtagatgagtaagagcccaaaataaccaagatactccaaagaagaactgagtgagggctgatttctgctacatgttgaagcaaaggagccccccacatgtagatgttgtggacatcacttgtctctgtcccttaagagaccccaaaacacacagcactgatgacacctgttctgcctctcacctaccatgggaccagatgaggttgatttaacttgacttgtcctcctaggatgttcctcctatcttactgaactgctcttggggattaaatgacaaggaatataataatgcctaatacagggaggactttgacagtgattcagcagtgaatctagagccagcctgcctgaattcaaatctcagcactacttcttatttgctgggtggttaatctttctctgcttcagttttctcatctggaaaatggaaaaaatagcagtacttcttccatatggctatcgtgaagattaagtgaattaatacatgtaaaactggaacatcacctggcacatagtgctcagcaagtattagctcttcttttcattttgtttacacctttattcttttcatcaaaatgctttcatccttgtgttactctttgacaatactttgcattaagtttaatttaatgttaaattgtattcaaatagtacataccttaagtgataaacacaataacatatttatttaacatgtgaatagtgaacacctggtataggctgaggtttaaagtgtctaggaggtcaaataactatcagtttattagggagatatttttcaatgaacagcatgattactgagatccactacaatggggatatgtaaatagtacagtctaaacataaaaaaagggtgcctgagtgaacctaagcaaatcagtccagaagacttcataaagaatataggattttctctgagattgatgaatgagtaagtgtcctggacacataaacatataagccagccattcacagaaatcagttaattaaaaacctttgcaaggtgtggcaacagtgtgtgttgatagacaccaacaaatcagatcaataatttcatttccttaatggcaaatgatacagaaaattatggaaacagataaatcagatgatgacacagcatactgtcacatggagatatatcttttcattttttcatggagtcttacagctgtggattcatagcaggcttgagtactctcatttcctttatcctgaccccagcttccttgtggaagttggcttgatgcctcctggaggctcttcttctggagacttgatatgaggctacctggtaactgaaagcaagtgactggtacatgtaaagaacaatacagtcctagatggtggttacagtgaggtcagagtcagtttccagaagtattcattggaccaacctccagcatatcccagatatgttcctcatattgagccggggtcctcaagcctctctcatcatttaagttacataactagtagctaagtctgagactcgctccctagtccttcaacttgtcttcaccaccaacttttctttcccaagaggcataatggccttgaagaaacagctttatttaatcatacagactgcagttagaacctactacttattaatagctgtgttttcttaagaaacttattttcatgtataaatataaatctcaattccttatttgtaaactgaggatgattatagctaacatatagggttccatgagctaacatatacaaagtggcttgtgcattgacagatatttaataggaatgtaataaattgtttatattcttttttccatattctaaaattgaactgtatccaatattaaatccacctgccccctctgtcaatattctgtgcttcacagtgctaatgattttctattacatttttttcagatatacccccatgaaagaacctctgttaaattttcagtaaattaaaacttaaacgtctccagatgggtccatgaatgactaaaaaaaatcttctagtgaaaaataacaagatcgtcaacagaaaaagtgacaaacataaagtatatctagccattatagaaaatgtaaaaaaaattatttgtattcacattaggcctattttaacacacaacactgtgtaaatgtccagattgacttttgttagaccatattgtcagatttattttagtagaagatgaagcacacacttcataatggagtataaaatttaccaaagttgtagataatccattcaaatggaatgtgtctatatgtgttttggactacttaacactgcaaatgcaacttcaaataattaaattaaaaacataaaaattattcccaaaagtaatatcatgggctactttacattttattcaatttaatctagcaaaaaattttgaatgccagatactgcaaagaattctacaatcacaactaaggggatggtcactgaccttggaagagctgatagtctagtgagaaataaaacaaatatatgaattaattataatataaaataaaataagatgaacaaaattggaagactaagctataaggtccactaagcagtggctattttttttcatttcccccctatgtatacaagtgtttatttgtattatttttacaatttggggattgtgctgtgtgttttgattccagcttattttcatttttcattgtatcatggacattgtttcatattcttaacttgttcaaaagtcgtgtttaatggccataaggtattccatcatatgatagtaatttaaatattcctctatttttgaccatttagattgtttactcactgctacaagcctcagaagaaataaaagagcaaaaatacccctaaacatttattattaatgtaaagtgtgttcaaacatgttttctactacatacattaagcaaagttactatcagatcttatattattgtatataattttgtagatataattaaacagtactactcagattaaatggggaaaaaaaacccaacacaggtagattttcttcttcttcttcttctttttttttttttttgagacggagtctcgctctgtcgcccaggctggagtgcagtggcgtgatcccggctcactgcaagctccgcctcccaggttcacgccattctcctgcctcagcctcccgagtagctgggactacaggcgcccgccaccacgcccggctaatttttttgtatttttagtagagacggagtttcaccgtgtctcgatctcctgatctcgtcatctgcccgccttggcctcccaaagagctgggttacaggtgtcagccaccgcacccggccgtagattttcttcttaacttgccttgccattcacatgtatatacctaccacacatagattttcataattgtacccaaatgctatagtttattgtgtacttgctattatttgctataaaatatttctttataataaacctattgtgttttggggtggtctactattaaaagtatagtttttttgttttttgtttttttttttagacggagtctcgcttttgccaaccacgctggagtgcagtagcatgatctcggctcactgcaacctccgcctcccaggttcaagtgattctcctgcctcagcctcccgaatagctgggattacaggcacttgccaccacacctggctaatttttgtatttttagtagagacaggggtttcaccatgttggccaggctggtcttggactcctgacctcaggtgatctgcccaccttggcctcccaaagtattgggattacaggagtgagccaccatgcccagccaaaagtatagattatcaacaataaattttaatattgggagctattcaaagtgcattctgtgtactttttctgtctcatactttctacagtctcatcctttctatagtctcatcattaattttataaaaatatttatctttgaaatatttacttgtgtaataatgactttgttattttaacaaaagagtaagtattcatgtattttggcctgtggttttttttgtttgtttgtttgtttgtttgtttgttttactgaatagcttgtggcttgccatctttatttaaccatctggtgaaatgtttctcttccatactaaaatggctttattctttaccattttacttgttaaaacttttattttagtatcggggtacatgtgtaggtttgttatataggttgtgtgtcacggggatttggtgtacagattattggccacacaggtaataagcatagtaactgataggtagcttttccatcttcaccctcctgccaacctcagccctcaagtaggcctcagtggtttgctgccttctttatgttcatgtgtactcaatgtttaactcccatttataagtgagaacatgtattcagttttctgttcctgaaataattagcttaggctaatggcctccagctccatccatgttgatgcaaggacatgatctcattcctttttatgactacatgatattgcatggtgtatatatacaacattttctttttttttttttaatttccaacttttaagttcagggtacatgtgcagaatgtgcaggtttgttacataggtaaacatctgtcctggtggtttgctacacagatcatcccatcacccaagtattaagcccagcatctattagctattcttcttgatgctcttcctcctccaacccaaagccctgcatcaggctggtgtgtgtcattgtccccagtgtgtccatgtgttctcatcatttagctcccacttataagtgagaacatgtggtatttagttttctgttcctgcattagtttgctaaggataatcgcttccagctccatccatgtccctgcaaaggacatgatcttgttctgttttatgactgcatagtattccatggtttatatgtaccacattttatttgtccagtctatcattgacaggcatttaggttgattccatgtgtttgctattgtgaatagtactgcattgaatatatgtgtgcatgtatctttataacagaaccatttatattcctttgggtatgtaatcagtaatgggatcgctgggtcaaatggtatttctgtgtctaggtctttaaggaattgccacatcatcttccacagtggttgaatttacactcccaccaacaatgtaaaagtgttcccttttctccacaacctcaccagcatctgttgttttttgatgttttagtagtagccattctgactggtgtcagatggtatttcattggggttttgatttgcatttctctaatgataacagtaatgttgcacttttttcatgtttgatggccacatgtatgtcttcttttgagatgtgtccttctgttcatgtcctttgcccactttttaatgaggttctttttttcttgtaaatttgtttaagttccttataaatgctggatattagacttttttcagatggtgatatggtttggctgtgaccccacccaatctcacattgtgggtgggacccagtgagaggtaattgaatcatgggggcagatctttcccgtgctgttctcatgatagtgaataagtctcatgagatctgatggttttaaaaaggggagtttccctacacaagctctctctttttgtctgccatcatctatgtaagatgacttgttcctccttgccttcccccatgattgtgagccctctccaaccacatggaactgcaagtccattaaacctctttgttttgtaaattgcccagtctcgggtatgcctttatgagcaatgggaaaacggactaatacagatggatagattgcaaaaattttctcccattctgtaggttgcctgtttactctgttgatggttccttttgctgtgaagaagctcttaattagattcatttgtcaatttttgcttttgttgcaattgcttttggcatcttcgtcaagaaatctttgcctgtgcttatgtcctattgcctaggttttcttctagggtttttatagttttgggttttacatgtaactctttaatccatcttgagttgatttttgtatattgtgtaaagaaggggtccagcttcagttttctgcatacgattagccagttctcccagcaccatataaaacagggaattttttctccattgcttgtttttgtcaggttcatcaaagatcaaattgttataggtgtgtggttctatttctgggttctctattgtgtttcattgttctgtgtgtctgtttttctaccagtagcatgctgtgttgtttactgtagccttgtagtatagtttgaagtcgagtaacattgatgcctccagccttgttctttttgtttaggattgtcttggctatttgggctcttttcaggtttcatatgaatttcaaaatagtattttctaattctgtgaagattgtcaatagtaagttaatgggaatagcattgaatctataaactgctttgggcagaatggccattttaatgatatcagttcttattaatgagtctggaatgttttccatgtctttgtgtcatctctggatttctttgagcagtggtttgtagttctcattgaagaggtccttcacttcccttattagctgtattcctaagtgttttattctttttatggcaattgtgaatgggagttcacattcataatttggctcttggcttgcctgttgttagtgtataggaatgctagtaatttttgggcattgattctgtatcctgagactttgatgaagctgcttatcagcttaagaatctttggggccaagatgatggattttctaaatataagattatgtcatctgcaaacaaagatagtttgacttcctctctctttatttgaatatgctttatttctttgtcttgcctgattgccctagccagaacttccaggactatgttgaatcagagtgatgagagagggcaaccttgtcttgtgctggttttcaaggggaaggcttccagcttttgcccattcagtatgatattggctgtgggtctgtcatacatatatggctcttagtagctagaggtatgttccttcagtaccttgtttattgagcatttttaacatgaagggatgttgaattttattgaaggctttttctgaatctattgagataatcatgtggtttttgttgttagttctgtttttgccctgaatcacatatattgatttgcatatgttgaaccaaccttgcatcccacgggtgaagccagcttgattatgatcgataagctttgtgatgtgctgctggacttggtttgccagcattttattgaggatgtttgcattgatgttcattaaggatattggcctaaagttttttgttgttgtatctcttccaggttttggtatcaggatgatgctggcctcatagaatgagttagagaggagtccatcctttttgattttttggaatagtttcagtaggaatggtaccaagctcttctttgtagcactggtagaaatcagctgtgaatccatctggtcctgggctttttttgtggttaggctatttattactgcctcaatttcagaactcgttattagtctattcagggattcagtttcttcctggttcagtcttgggagggtgtatgtgtccagaaatttatccatttcttctgtattttctagttaacgtgcatagaagtgttcatagtattctctaatggttgtttgtatttctggcatcagtggtaatatcctgattatttaatatcccagtatttctgattgtgtttatttgaatcttctctctttttttctttattagtgtagctagtggttttgttttgttttgtttttctttgagatggagtctcgctttgtcacccaggctggagtgcagtggcgcgatctcagctcactgcaacctctgcctcctgggttcaagcgattctcctgcctcagcctcccgagtagctgggattacaggcatccgccaccatgcctggctaatttttgtatttttagtagagacgtggtttcaccttgttggccaggctggtctcaaactcctgacctcaggtgatctgcccacctcagcctcccaaagtgctggaattacaggtgtgagccaccacacctggcctgagccaccgcgcctgacctattttattaattttttcaaaaaaccagatcctagatttgttgatgttttgaagggttttttgtgttgctgcgtttttcagttcatctttgatcttggttattttttgtcttctcctagctttggggtttgttttctcttggttttctggttcttttgatgttctagttcttgtgatgttagcttgttaacctgagatctttcctagcttttttacgtgggcatttagtgctataaatttcctcctcaacactgctttagctgcatcccagagattgtggtgctttgtatctttgttctcattagtttcaaagaacttcttgatttctgccttaatttcattatttacccaaaagtcattcagagcaggttgttcaatttccatttagttgtatggttttgagtgattttcttaatcttgagttctaatttgattgcactgtttattatgatttcagtacttttgcatttactgaggagtgttttacttcagattatgtgatccattttagagtatatgctgtgtgacaatgagaagaatgtatatgctcttctatttgggtagagagttctgtagatacctatcaggtctgcttgagctgtcactcagtcaggagaactgggatcagggtcccacttaaaggagtaatctggctgcgttttggtggagcagctgtactttactgaggaccccttttgtccctgatccatttgggctgcccaaggtccacaggctggaccagctgagaaacccaaacagcaaaggtggtggcctgctccacccaccatgcccgctgtcttagagagaaattagaactcttgtcagctgtagtacacagagggaggtggctggagaccccaagtgggaggacccaccctcgagggggatttgtaactcggggtctcatttaaagaagcagtctggcaatgcctcaacaaaacagctgtgccatgctgtggaaccacttttgccctggtcagcttggactcttcaaagcccgcaggctggaaccgctgagtcgtcaaaacaaccaaggtggtggcctgcccctcccgcaaggcactctgtccgagggagagaccagacctctgtccatagaatatgggctggtagggggagctcaggcctctggtgggaggtcccacttagcgagaaggaatagatcggggtcctgcttgaggaagcagtctggccacattctggcaaagcagctgtgctgtgcggcgggactcgctgctcatccagaccgtttgtactctgcaaagcccacgggctggaatggctgagttgtttaaactgcagagatggcagcccacctctccccactggggttccatcccctctcaggcagcctccacactgtttccagctgcctggaattccaagccactgggtcttatcttgtgaggaaatggggcctgtagaactgacactgctcagctccctagatttagccgccttcctaggggtatgtatgaacctcctgccttgctggggatcccggggccagagtatgtaaagctctgggtctctgtgctgcctgagcaaccgctctgttgagactccacagagttctgtgtgttggacccaaggccctggtggcatgggctcatgaggggatctccagatctgagggttgcaaagatccgtggtttcttagggttgtacattcgttcactgcttcccttaactgggggtgggggttcccttgactacatgtcactcccagttgggccatcacctcaccatacttttcttcattctccctgggttgagttgttttcctgatcagtcccagtgcaagtacctggatatttcagtagaaggtgctgtatttactcaccccccttttgttgctctctgtgagtgccacgcactacagttgcttctgttccaccgtcttggcccccgatcccttgttttttttttttaagttatttatttttatttatttttagagacaggatcttgccatatctcccaggtttgaatgcagtggcacaatcatagttcactgtatcttcgaactcctgggctcaaggaatccttccacgtcggcctgccaaagtgctgggactacatgcatgagccaccgcaactggcctgtttccttcgtctagaaaatgaggctcttagtagttcactggcatggtgtaaggagtgaattatggaaaatatgtaaagcacctaccacaatatgtggcatatagtaagcacagaataagtaaccaattccttctcttttcttcctgtttacaccgcaatttagagtattaactggcctgtaaaagattctgtaaagaaaaatgctgtatcagttagagccttttaaaaagtgaaaatatctttcggggatcttcctcccatcaggcaagttgttggactagggtcacttctaaggtttcattcctatgctgtgattttaggattccgaaacagtgaaaataactggtatgcttcattaggcagtacagtgtcaagtttaggataatttactttgacagatcataaaacagatgttaaaacatttataaacctcaatgaattattttttaattcacagtccaattatcttaagattttaagccatgcttgttttagatttccttgaatcataatgattttgtttgcgtatgaaaagtaattccaattctgtatcattatgagacaaaatattcagtgaaactcaaactgctttttttttatttttcaaagcctttttttccttttgcatcgactttatttcagttcttcataagaatataaaatatactccttttcatcagaacttttcttccacagccactaagttcatatcatatgactatttggtgggtaacaatattagcaaatatgtttatgatatccattctttatttaaccttactcttaataaatggagaaaattatgaaatcaaggtacttcccacaaggaattcttaaagggctttataccaataacttttgtcttgtgacttctgttttctttgcctagaaggaatggaagaaatgagaggaaactgatctcatttgttttactctctcagtggctagttattatttccctgcagcctgaacattggttttgttacagagctttgtggactgccttcttgtttcatgcatagactatgccaaccttggatcgcagtggagggcagaagctatttagaagcacccaacagtgtggcttttattctgattgttttcaaatgtgcttagttggctcaaatcaggcttcccagaacagaatcttagggtggggtttagaattagagcagcatttctccagaaagatttacgctgtcaaccttttataaattaggactctcactgggcttgctctaattctttaaaacatttgtattccaattgctttcatctttggttgagctgtctggatcagatgtggccgttctctctgattttgcttctgatacacacttagggcctgtgcagtttctctcctttacccttaaggggcagacttgactaaaattcaaagatatctgtgttttctattgctgccaaaatacccaaataccgttccaaaatacccaaaacttaaagggtacacccccaacttaaagcaacacagatttaatgtcttacagttctgtaggtttagagtccaacacacatatcaatggtctaaaatcaaggtgtcaacagagccgcattcctttctggagaattctctaggggactatctgtttcctagccccatctaacttcttgcggcctctcacattttttggttcatggctcttcttctgtcttcaaagccacagaaattgcatctcgcgcatctcgctgacccttcttctatagtcacagcatctgctcaatgaccacagctaggggaagttcaccaattttaaaggcatgtgattaggttgggcccatctgggtaatccaggctactattcccatctcaaggtttttaattacacctgcaaagtcccttttgccatgtaaggtaacatattcgtagttcgaaggattaggacatggacattttggggacaattattctgcatatcacaatccctttctcttttccttagtagaccacactagtctggtgacttgaaggaacctagccatttctcttctacctcaccacagtgggcccaggatatagtcattttaaaaacataaaacccagtgtatcaggctccaggccagggcttctcagctgactgtttctattggtgtaacagactggattttggctgtctctccctctactttcctccagcagtctttggtcttgttttgagatgttttccctcctgtggtcctcagtctgccagtgttcttcctataactttatctctgtgtgtcaggatatacactgtactctatagaaatggcagtggaaccccaacaattgtgggtgtttgggtaataatccacaaccttatcattcccaacacccttcccattgtagctttcctctataaagagaagtttggagctcctaaaaccagatctgaaatttatttattcaattaatcattcaaatgtgcaagatgtggggagaattggatatagagatatggctcctgccctcaagaaattaatagtcaaacagggagaaggacatgaaatacaagcattgctgtatgtgggatggatgtctgtatatacagttggtcctctgtatgtatccctgtgttcttcatctgtgggttcaaccaaccacagatcaaaaaaattgggggctaggcgtggtggctcatgtctgtaatcctagcactttgggaggccaaggcaagtggatcacctgaggtcaggagttcgagaccagtctgaccaatacggtgaaaccccatctactaaaaatataaaaattagccgggcatggcagcatgcacctgtagtcccagctactcaggaggctgaggcaggagaattgcttgaacccgggaggtggaggttgcagtgagccaagattgtgccactgcactccagcctgggtgacagagtgagactctctctcttaaaaaaaaaaaaaaaaaagaaaagaaattagaaaaaaaaattgtactgaacatgtacagactttttttttattgtcattgtttcctaggcaacacagtgtaacaatcatttacatcatattatgtattgtaaataatctagagatgacttaaagtatatgggaggatatacatagattatatgcaaatattacactattttataaaagggacttgagcatcttcagattttggtatctatggaaggttctcaagccaatcctttatggataccaagggttgacatatgtgtatatttatatatgtgtgttagttatctgttataatgggagcacaggaaagataagcccttaaatttccctcagggattcagggaaagttgtccagaggcagctagggttgagcagcagatgtcatgacactactaaccagataagtcttctcctttcactcaggccttatggaataagctatgcttgtggaattttttatgtggaaaagaattacatgaaacaatctgcattgctcttctcactgtttttagagggaatcagtaggaatcagaatactggctgactctttaggtatgtgggcttatatgaattttttagctctttaatccttagtttttccattagtagtacccaacttgctgaattgtgaggtttgaatgaattattaaagttaagcttttagaatgggacctactacccagaaaatatttaacaatattattgtaatgtatcactgtcaccatttattactacaatctctcttgaattactcatcacttttctgacatcatcatatgaaacaagttttttaattcatgccagcttctccctcttacttacggtttaggagttgcctctaatgcctaaggaaacgtgtagccctctggttgtactgcaaaagtggttgcattttgaaggcaggtgtatacaacttccagagtaagaatatgtgtattcaggtgtaggcgttgtcagtttccaataagataatttataatgcttaatttatattaggaagatctcacattgttctcttctgtaaattatgcatgtatttgtaaatctaaaaggaactttgatttttctctctgattaaggtgtataattataatcttaaataaaagtgaagttcaaagtagcttcatttaaaatattaatagacaaaacataagatcagttcttttagggattggtttgtcagccacatgttagatctgcttagaaatcttcagtgaaataggaaacattgtataaatgttacctaatgtaaatactgctaaatttaagatatactaaaatttgagtattttccctttagtctcaaataagcaaaaggaaatctgagttatatgaaaatgaaagcatgtattcagcttttataaaaccattataaataagttatttttcctaccaagttaaataggatatgtttacatgttttaaattttagttttattagttacagtatcatattgtgaatagtagcaaatatgtccttatatagttctgggttcttgctttataatgtacatagacaaatatctttttaaaaaaatttttgtgttccacagacgcaacaggttttgataatttcttatttcacctgttggttacagtcacaataatatgttctttcttctaccttatgattgaccatttctgacataaaagttaagaatttgtatcatctaaacagccttttatgtcctttctcttttttcatacatcttgataattgtagtgtttttcatgtttgcttctattttctatctttccgagtttgcaaaacattattaaaacttcatttctagttcttcactaataggacccaaatctaagtctctcaacttcaggctctacttaagtatccagagttcacaattcagcgaccgtttccagggtggaggcctgtagaagaatcagtcctatttttacaaaaacagagaaatttgtgctcctaatatttgcatagtcataaaattgcaaaagttatattggttttacaattttaaattgataggcaattatgatttttgcaaatgacattctaataaaaattatcaacatttggttatggtagcgatggtgaagaaacacagtgaaagcaaatattttcttatgtcacttatacatgtacaacaatggccatatttctgaaatgtaaatgaaagtataatgccttcttcgatttttattttgaccactgagtaaattaaaccttcaataatctcataaaaatgagatattttcttgctatacctctgatatcccctgtcccctgaaaaaatatgaaattagtacagagccagtaaaaaataccaagaacacccaggatagattctatcctaacctaaacaagcttatattatgaaagtggtgttattttttaacagatcataaattagacaatatagttcatctagggccgataacttctccccatgcagctgttgtcactcttgggaggtgcttcctagaatgtgtgctgagaaggatgctataattagtgatgtctgccttgggtacagaatatcagtagtggttaggagcagtacacattttccatccttaagtatctggatgggaagagatctagagaacagaatatcatatgtctcctgactcataacttgggatctttcctcaattctactgaataacctgtagtggaaaaccatgtttctatagtcctatccctcgtccaggtggattatctgaacaggactcctgtggaatggttgtggtaatgtaattcatgtggacattgacaagttgccatcatgtggtcatgaggatggtgttggattccttatgtgtgaggctgataagggccctatgttcaattcttagtggtccttttaaacctacacctgtttatattttttatcaacatgcccataacttatttttcgtgaatccactgaaacttccagagacttgaactttgcctaaagtttaaaacaggaattttttaaatcccttaaatgaaaaatagttttaagtgtatcccaactaatatgaaacaggaaactaatgtctaatatccttgggaactataaaatattcaatagtaatcaaaacataaaatgattctcttctgtctttccgttattctctacttccaattacattttgtaaaatgtaaacaattgcacctgcaattgatggaaaaataccatcatgaaatcaaatgtgttttctgacttcatatatgtattgtagtatttaatattaagtaagctcagaagatacttacatggaatctactgccttttctgagcacaagagaagcaatgattaatagaatgtggtacttgctccaaggagcattcatttaagaggagggatgctcctatttgggtcttcactgtataaagcatttatatgtatattacttaacaactaaaaggtatgtacttatgcagaatactgccatcattgctcttttctttactgtaatggtaccattcatcaggtccatggaagccagcttctcacacattctctcttagacataggcgttttctttctttcttttctttttttttttttttttggtgacggagtcgcactttgttgcccaggctggagtgcaatggcacaatctcggctcactgcaacctctacctcccaggttcaagtgattctcctgcctcagcctcccgagtagctgggattacaggcgcgcaccactacgcctggctaatttttgtatttttagtagagacagggtttcaccatgttggtcaggctggtctcgaactcctgacctcgtgatccacccgcctcggcctcccaaagtgctgggattacaggcatgagcccccacacctggcagacgtgtgttttctaaagtggatttattagaaattgggatccccttaaccatctttacttagaggagactttggcttagtgacctacagttgtgtgtaaatgaaaagcaaaattaatgggaagtatactcacaaaagaaggactttaaagttgcaaaaatagcatgcatcaagaatagtataaaattttaattcctccatcgtcaccaataaacatttatggagaatccccagagtgactgactctggattttacatcttatgttaaactaactcttgcattctgttcttgctgttttataattaccccaaatgttctctgttacttctcctaatgattcttctttttttttcttttttctttttttttttttttttgcatacagcagagaatgcctgtgggtttaaaaattttttaactaatcttgatgaatcaattataatttataaaagtggagcataacagttaagagctcatgctatggaattggacagagctgatttcagatactgttctgccacatgcaaagtgcataactggactagtcacttacctttctgaacctcagtttcctcatctctgaaggggatgatgaaggttcagccctctcatagggctcatgacaattaatgagataatgtcacatgcttaataccagcatcttgtatgctccataggtgttagctgtctgtttgtaataatatttttgtgtttggttacacaaacccactttcttcatttgttttctgctattaatgccttttgaagtattgtgttgtttgtgaacacatagtacaaattgacttttgtttttttaattatcaattttgtttctgtaactgcacagaaaagtgataaattgtgagcttatattttcttttaatacatagatatcgcctcccaacatacatgaattttaagacactaaaaaccccttaaagatcttttcttaatcagtgtttagtaaatgggcttacattctagcgtatagaccaattcaaactgttctacagtagagaggaatttgtatgttggccagtttttcatacagtgatttctaactctttccccttcagtatttccctaacatacactttctcatccagtatttcttttagaattctcacacttttgccctcataactcactttcatattcctagagctcttttcttcacactgattgtgctgctccttttcaatttttccaaccttatggaattattagtgagaaaaagcaaaattattattatttgagacggaatctcgctctgttgcccaggctggcgtgcagtggcgccatcttggctcactgcaagctccgccccccgggttcacgccattctcctgtctcagcctccggagtagctgggactacaggcgcccgccactacggccggctaattttttgtatttttagtagagacggggtttcaccgtgttagccagggtggtctcgatctcctgacctcgtgatccacctgcctcggcctcccaaagtgctgggattacaggcgtgagccaccgtgcccggcccaaaattattttttatatatggtgactttcccccaccctttcatcttacagtagaggcagctcagaaaaaaatcactgaattaagtcattcagaggtcgtttataatagctattcagcagtgagctggttctcagtcctggttatccattacaatttcccagcatttaaaattctgataccgtgaccatacccaagaataattaaataagactttctgtaggtgggacctaggcatctgtttttaaagcccttcaggtgatcttaatgggcagctaagtatgagagctactataggacagtgttgtatggcctgattaggtaggaatgagagggagaggaagaaatcaggacaggagatgtagacttattttgataagttttggtagtgaaaggcagaaaagagatgggactgtaacttaaggaattagcaggaaacacaacatacctgagaaagaacattctagcatatatatatatattagcatatatagtagtgagtctcagctactcccctagggcagtgtatcagcaatttaggaaccagggatgaacatgcatttggcaaaacttcctaattttgatacacctttccctttctcactaccctcccttctctcttctctccccagcccctgtctacaatactgctatcctgctccctctgctcctcgtccttttctttcttaaactgggtgacagagcatctcaaagttgacttccctcatggtggccatatggctccagcagttctcagcaagagttctgaattcaccctgattagaccattaaggtcgtatttcaactagtaactgaggctgggggaatggaatatgctcatttgtgaagtcaatcaagaaagtacataggaagatgggaaaggatgctggtagacagccagtactacccactatatatgtaaaagtcacagtgattcaatgcaatcagttattttacatgtgcaaattatgagtggtcttgtatggggacggttttgaataacatatagaaagtactatatagtactgatatttttctgagcatcaaatatttagagaaaaaaatctgtggtgttttagaatataatataataaacatcaaataatttactagatcaaacatggtttattaacttaaacactgtagcatatagcagtctgtagcacatcttactgactgatccttttttgaaaaaatcattacttcacattgttgatgttgtggcagaatctaggacttctataattacatttctggagattatcaggcaaatgtgtggcttttaccttttctggttactattttatagaaaaatgtaattgctaggtatgtcatttaagaccctgcaatctatttgtctgaaaaatggaacaaatgctagtaagaattttaaatgactctcaaagcctcctgcaaaatgacattagcagttgaaataaaatagttaacagtctaaaaactgtttaagataaagcccataactattaattttaggactgttttgtatacaatgtaaatgacacatgtttgagttaatccatttgatggtggtgatcacattcttaagaaatgatttggtatctcaaagcagtttcttaactagacaatgagcagaaaacctgttgctagttttggaagtttaaattgtcaaacttcaattacttctgtttaatttgggattaaagtttgggattaaaaacacatgagcaaaaatctcataaccccagttcagtcatgagagaaacaccagacaaatttcagttgagggatattctacagaatatatgtccagtactcctcaaaactgtccaagtcatcaaaaaacaacaaaagtctgagaaactgtcgcagccaagggatactaaggaaacaagaggactgaatgtaatttggattctggatgggatcccagagtggaaaaaggacattagagcaaaaccgaggaaatctcaatacaggttgggctttagttaatgtgtcaatactggttcattaattgtgacaaatacactatattagtgtaggatgttaataatattaacaatggtggaaaccggttgtgggatatatgggaaaactgtgtactgttttcatagtttttatctaaattttaaaatacctcaaaataaaacgttatttttaaagatgtggggatacatttttcaggaaagagtctccgccataagcttactatagcagagcctgaatgctactgtttgatgaatgaaagaagtccggtattcttggagatcttctctgtaatcctccaggctgaggcatcacttagatttggcatttgagacctttattgttgacctatgaaattctgttttatgtctgtctctcactttgtttcaccatagtatagtataggttataggagcaagaaaactgatttttctttcaagatccactgtatgccaatcatgtactggatttcactaaaattaacacatccaatttttagaaactttgtaggatagaggactaccctttctacaaaagaggaaaacagactaagaagagtaagttacttggccaggcacagtggctcacacctgtaatcccagcactttgggaggccgaggtaggtagatcacttgaggtcagtagttcgagaccagcctgggcaatatggtgaaactccatctctactaaaaatacaaaagttagcagggcattgtggcttgtgtctgtaatcccagagaattgcttgaacccaggaggcagaagttgctgtgagctgagatcgcaccactggactccagcttgggcaacagagcgagactcagtctcaaaagaaaagaaaaaaaaagagtaagtaacttgcccagagtcacacagatgtttactgacagactacatgagagccttgtttattacttgactccaatttccagcctttctaccttctcatatatatgccttctttgttatcgtaagattcagattagcaaggtactctttttaacctgtgcctatgttttaaaaaaaaattgtttaagtttgacataagtataagccagcaggaagttgcaaaaacagtacagatgctccccaacttatgatggggttaccttccagtagactcattattgaaagtatcgtaggtcaaaaatacatttaatacacctaacctgtaacttagccttgtatgctttaagtgtggtcattagcctacagttgggcaaaatcatctaacacaaagcctattttataatgaagtgttgaatatttcatgtaatttattgaatactggaagtgaaaaacagaatggttgtatgagtaaagtacggtttctactgaatacattttgcttttgcaccattgtaaaatcaaaaaatttttaagttgaacatttcttaatttggggactgtattagttcattctcacaatgttataacaacatacctgagactgggtaatttataaaggaaagaggtttaattgactcacaatcccacaaggctgggaaggtctcaggaaacttgcagtcttttgcatttcaccatgaaagagttcgtccaactttttaggtttttattacaaaataaatagtgttttctctgccctctctgtacctcgtatttgaggaattctcatacttctctttcaagatgtctttccccacccattttgtttatggtggtaatattataccaatatggccagcttttatgtactttgtgatctcgctactatgaagttagcccccttcagcatttattcagaataatgcctcttaaaaaagtgtttaatgatttcataaggtccttggtgtttcttaatgtcttcctttctcttttttccctccccttttcccctccccttttctcccctcccttctcccctcccctccctcccttccttccttcctttcattttttctctgtgaccatctgtatgttcttttctttttgtctgccttttagtattaaaatggtcacctgacgaccatctgagttgagctttgtcaagaaccaagggctgaagttctttttgttcagactatgtttctgttaccagtattgagggactaaggactttcaagcccttctcattctcccagcctgagagatattaagataagggaaaactagattttgcaggtaaactttgatttgttgaatgcctgctttgtgccagacattgcatgctacgatatattctattaaaaggattcaggaagggcatttactcttttagctactggagtttgattttctttattatcatgctgatcagtgtacactggcagtgtggctgattgagtggaaaagggagagctacactgtcttgtcactcacctagttgataacagattcaggacaaggactctcgtctcctttctaatacaatattagccctaaacccaaagaagttgagatgttttgtcattctttagtttttcccaaagggaacatttttcacaacataaaaagttagctgattggaattaacttatactttataagagatcagtgcatatctagaggcgacatagtagaattttcaaacaatcagaaatctcataaatcggaatctaagggaaaacaaatataccctcctgaacgttgtataattgggtatacagaaaactttctaattttattttgccttcatttttagactaacttgcaattaccccaagttgctaggtagcaaaattattatggtactagctcagaatttgctgtattttaatcagccttagtgactgaaaacacagagagaatgtcaatgagggagaaaggttttcctttactgcccctagataaagcagatgaaaatctgtttctctccacggtagattcctactccttgccaaagatacaatagacaacatttataaaaatacaatctttgtgcatgttgctaggttgctcaattttgagcctttttctttacaatacataatcatttaaaaaatactgaaagaggtaagaaatagggagtggaaaccagtagtgtgagtaaatgggaaattgatatctttaaggcactagatatggtaataaatatattagattactagaagagaaaaaatacttgaatagtagccaagaaaggattccaattacttacaaactacagtgactaacttctttcaattctaaaatcccctattttaatttttctaagtttctgagaaatgggcattttagtattactccttaaaaacttttttactgaataaaataattttcatgaaattacaaaaacataggatctgctcatattgatagtgtgtttgacttaccactcactgtattgtgtctcacttagattaccagcaaaaatattactcacatctaatgatatttctgggtatcctataaatgaaccctgagaggtttcctggagagtcttgtaatgcttcctagctacccctgtatatattctataaaatatagccatgtaaagtatgaagacaatctgttactgtcttcctggcagggctggtcaactggccatcagacactgtggttgcatctggttgtcccctgcttcctactgctccattgtcccactttgggtgtctccccctcctccctgtgctggtgctgccctttcataggccttctctcaataactggatctcaccaggctcctttctgcattcctagctttgtacttgctgtgtgacctggcaggagtgcttctcctgggttctttgcagatctggtttctccttctcaaatgacaccaccttagaaagccctttcctgagcatactgtgcaactcagagctccctgttagtctctatcacagaccccttacttacttcctttttagcactcctcaaacaccttcccccaactaaaacataaaactctatgaggatagggacattgtggacactcacatattaataagtgattgaaacatgaatgcatttttaaaaagatcagtaccaacatcctaaaggctcgtggagaagggcatttgagctgactttgaaaagtagaatgtgaagatagcagggtgtaggaaaacaagagttttagaagagagaggcttgtgtcaaggtgatcttataaaaaaaaaaaagctttggtatgaaggcaggcatgtgcatgtctttactgggctttgtggagaaaatagagataaagaataaactttggggaaccaggaaaaccttttatctaggaaagggacatgatcaaaatggcaccagtgtggcatctagtggatgagttgaaggttcaggaattgctaagaagtaaaagcatccacaccctacttcctgtcttgctgacatatatatatatttggcctcatcagtagcaaagctcattaatactccaggatgatacagaatagaaatacaaactggaattgtttgtttaatctatatttatgcattcacaaatatttactgatccctgctccatgtcagtcattgtacctctgatccatttgggcttgtaaatctgtgtatgtgatacttggagatgtttttgcatacctaaaatgagacaccacttaagagatttagctgttgatactcgaaccagtgaagacaaagctggcaaatacctccctaaataggaaggatatgtatttaatttggaaaatgtcaatttatttgttaccctacacagtaagaattagatatctagaaacaactacaggtatgaaatataactgttgaaatgtgtgcttcttttaagaaactccaagagctacgtggaagcatgtgttgttttcttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaacaaaaaaaaaccaaatttaccagattgccagtaatttgcattaaggaggaagagatggatttttttttaagtcagcaggcattgaagatagttcagtgaagttaagtaatagagatctcagattttaatttagtcaagattatgattttacatagaagcactgttgaaataggcttgataataatattttaagtgttatacaaatctggatgaaattatattatttactgtcttactcattggttcaactgtgttttaaaagtgagagaccttatatcaatgagtgtttgttctgtgcatctcatgtgcatggtgttaacaaaataaaataagcatacttctaacatttgggggagcatcctattagtttgggggtaggttagggactctgctttccaaataattaatttgatagatccatgctcttgaaaaattgggtacatactatttttaaactttatttttcaaacatgatatgtattgtttaaagcattagcttaaatgaaaaataatattttacattcgtaaagttctgtttatttaattcagtaatgaaattaatttggagttgttggcatactgccttcacaggtttctgtgactcatttgctgagaaagtgtgattcaagagaccagaatcatttttttctcatttgctaaaactcatgttttgactatgggcaaatgttcatggcagatttaaaacaaatttaaagtaaatattctgtgataatatttggaagctgagtgatgtctagccttacataactaggacaaatataaatctgtgagttcacggacttcaaaagtatcaactatacatcattttagaatactggttttgtttttctcatattcttagagtttaactcttatactactaattatgacctctagaaggtaattgcatttagaagcagaatatctgctgttttattaatttaataattaaggactaaatggtgttccaatttaggtttaaaagtaagcacattcacacagcatttaaaactatttcttaatgtttttttcctagagaagaaatgatagctccatgatcgctatatgttctgttcaatactcattatatttataatttatattacatatatatttatccattatatttataatttagtcctgtccaaataaaatatattctcatagttaagtgtgttgtggtagtataatgattacatgaaataacctggaccttgctgtttgcaaagtaatttaaatgtttattttctgagttgctacttggaaattaagttgtggagtgatgtttctcattggtccaaggagcaacataaaatcctgatttatcagataatcctacaggaaacgtatgcctgttttgacttatgatatgtttcttagtacaatgtcctgcttttctggctttccattaaatgtttagaaaaattagttaatagttttgcaggaaaagaaaggaaatttatcagtctataccagctatataagaagtaggaacatatataaaagacctataattttccgatctcactttgaacttttcttcacagttttccaactcaagatggtatatagtcttgcacaatgggctgtagccaactttccgtcagaagaactgagtaaaaattattccaaaattgttcttagaaataaatctgagcctggaattgtcttgcattaaaaaacaaaaagcaaatgattgctttaaaagcacaccaaatgatattggatggtctttattcttgactctgttttttaaagtgtgtatacgttcattacatccagttgtctattgggcttttttactctaacttttcggaagttgactgacaggccacttttctatagtgggaaataggcaccttgtgtgcgcggagggatttccagcccccgaccccggaaccagcaattagcgtttaggcgtcctgcaccccaccagggggcagcaccggacactgcctttcctagaggcctgagtgcatttaaggctttctggcagtgctctccacccctcttcctcatacaggccttacgtatttttggtattttcttacacattttaggcttagtaagtgtttaataaatgttagctgtttaggcattgtgctatacggatgctacttttcaggtttgaccgttctgtgtacctgaattttgtctttaatgataatttgttctattatttaaaataccttgtgcttattataaatatgggattcctttaacttgtaaaatctagcaattattgagcactatgacatgtcaggcatgaaaccaggtactttttatatgctactgcagaatctaagtagacatagaggcaagataacaatagagtcataaaacaatatgaaactgcaataatggggaattgtaatacttctattttgatgttgaataaacagtataaacctcggggaggttaagtcacaatggaacaaagatcccttcagatagaattccaaattccgtgctgtatcaattatattatgaaaccttgccataaaaaaaaaaattgttgaggatgagcgaagccacgatgtgtaatgcctgagacagaggtttcagtgatgtaactccagtgacactgtgacaaggagaattagggattgacatacttaaaacttgaatggagaaatagggttagatattgagagatcccaaggaaacctgtgaaaaccttaatatatgtgtttttatggacacataatatgtaacatattacattcatcaaaacatgggaataaattgacgtactcttaatttttaaaagccccataaatatattttacttaaaaccgtaatggatcttattcttttaatttgtgcttgtcctctcttacctgctagaaaatttaaaggttgtctgtccttcctaattttaacaagatacttcattttccaaaaatgaaacaagacaaaaaggtaaatttgttttgttttgttacagaaaatagtcaaatgaagatattttgcctgtgtctgtgactttaatgatttggaattgttatttcacattgtttgctttcttttctggctataatgtgcatagcaatccagatggctaatatataaacaattggagttatgcttattggaatcatttagtgtggcttaggaggttcccactacccaggaccatctgttcattgctctgtgtattaccttcatgatcaagtttgtgttttcagctccttcacatatcttagcctacacctttctttatatgtgaaagaggcttctaagactgaacttaactcatatggccctcaaggctatattgtcaaaccttgataatccaagcctgccttccacattaccattcttctttattcctaattcaattttttcccttatcattgctattctcaatagtagggtcttaaaatttgcagaagagtgactaagaaaatgggctttgtagtcaggttcgaatcttacttggctgtgtatgtagcgatttgatcttgggcaacctcctttatcttggtttcctcacctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacagccctgtaggctatgccattacttaattcccaatttatgtggcttactttttctgaatgaaaagtcatcaaatatggtttttaagttatggaacagaagaatatgattaatctgaattgtcatgaaaattcagggcacatggttgctatggttatggcgtcatgtatttataatggagagatactttgtcttcattaatctacaaacttgccagtgggattcggtattttttttctgtgtgtgtgtgtgtgtttgtgtgtgtgtgtacatacgtacgtacgtacatgtatacagcttctgcatgaaaacactgaggctgaacaaggtgttctgttttggtggtagtgcagagaaacatactcacacataaattatttatatgtgaaccaattcagtgagaagtaagtacagctgcttaattgacctaagggtcttatttccaactgcttaaaaataagtgtaaagtgaagttcatggaagaaataacttaaggctctttaatatacttttgttggtgaagagaatttcaagctgtttcagtcagttagcatatattcttaaaaagactgatatcctattcgtagtcttctcttatatatccttgaattatcttccatgatttttatattttatatacttataatagcgtattataacaacttaatgctacataatttacagtaatcgtttccaaattaaggaagccctatgtgtaaaatcacaaatttatgtaacataacacaggaacttttattcatataagaaaatcattattcactttactgttttcctttatttcagcatcatttattacaaaattaatactgttttcgaaaaaccaaaacaatatattataaagcacaacgtggagtcttctctcacctccttgtcattcccagcctcaaagggtaaccactgtttacagttcaagtgtgtcttcacagcagatgtttttctatgctcgtgcagacatatagatgtattcctggaaagagtgatgcttgcattcttgaggagttaggagcattgctatttgaaaaaataaaaatccagtttgatgatgttagtcattatgctgaaaggagtgattttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgtattaaaagtcctaaagttgttcgtggagatttccagttgctagggaataccaacacttatttggtgtttgatattgtaaatcatgatagttattggggccaaagggaggtctgtaaatgtccagtaggttctctttggagctaatttgtgctgtttgcattttctttctgccccaatacacttgtcactggaagaaatcacacagggggtagggataaagcatgaggtatcatgattccttcatgtaaaaattttgctcaaattaaaatgtgaacatagtataatatgtaaaaaaaactggacctccttaaatcctttataaagcaaggcaatgtgtaaacacatgaataaatatgaaggttttattttaagtaatagctgtgaatgttaaaagtaatattattttccttagaatagtttaatcacatatcccttttaaattttttaagcctttaaacgttttattttcagtctgggcttggggactcacacctgtaatcctagcagtttgggaggctgaggctaggggatcacttgagcccaggagtttgagaccagcctgggcaacataagaagacctcatttctgaaaaaaaaaaaaaaaaaaaaaaagaaagggaagaaaggggaaggaagggaaggaaagggaagaaaaaaacgaaaagaaaaggaacaaaggaaggcgtcggtgatgtgcacaagtggtcacagctacttggtagtctgaggtgggattgcttgagtctggaagatcgaggttgcagtgagccgtgtttgcaccactgcacttcagcctgggcgagagagtgagaccctatttcaaaataaattcaaatttgaatattttacttgagtaacattttttttctcctgaaaataattttctacagtgttctactgtggttgaggttttcatgtttaaatcagatctctagcctcatgggactcatagtctctcatggaagacagataattgggcaactacaatggattatgccgagttcggtgctttgggagctcagagcacaagccccttcctcatctgccctgtagggctggggaggtgctgtcaaggaaggcttcccagcgggagtgattcctcaggtaataacctgagatttgtacacacatcagtcaggcaaagagctgtggacttggggtgtgagtggccagagacccagcattatctgcaaaagctagactatgagagagatgagaacacagttaagtaactgatagaagttcagtctggctggggcatggaggaattacaaacatttattatgaaagtaatacatgtgcattgtataaaatgtgagaaaaacagaaaatgagaaggtatatattattgccagtttcatgctgcagagttaactactgtgaacatttgttgcatttttataattctttccatttatattcgtagaacagcgtatttgatattatcccagtttggcttagacaatagatatatatacaggtataaaatgcatatgcatacatgaaaacacataataaaactgggatcatgcgaacatgctgttacctgcttttttcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 1402 - DNA, 239644 bp, Homo sapiens; identical to SEQ ID NO: 1401

SEQ ID NO: 1403 - DNA, 148651 bp, Homo sapiens
agctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccacacttttttttttttttacatgttggatttattgctccatcaaagggccccaaaagtttgttaatgggaaaaaaaaatgtgtatttgatagaatttgcttaagtgcagtcggaataattttgaattctagaccctttgacaactggagcaatttattttgctattgtattgtgatttagggaaagttttcttgttattcgacacctgtttgtcactgtagcagtaaagagtaatgagtgtgttgattcatcctctgtagtggtattttttatctctggtgaaatttatcatcttgttcatggtagaatgtatactctgatagcttttgcagcttatactttacatctgaaccatttgtgggccttcatgaatttagtaattccctcttcagtggaattaaagaaagtttctgctttttctctgaatttaacgccagtttccaagagcagaacacctgtgtttttgagcctcagaaggtgttgagggcaggtagaatgtatttggtatgctggtggtccctggaatactttatagtatagagtcatgggaacggttttgctctccagtaggttaaatagattcctcaattaacattttgaataggttccttaattgacttataatcaatcatatttgaattattgtttttgatctaaaaagtagttatatgcttatggtagaattctccctatgcttagttggaaagatatgtggctgaaatttgtattaaatgactttgaggcatcaggtcttacaaatttaatctgtgggcgtattattgacagcttgatttgcgatatgaaaatgagcctagatatttttattggagcagttgtttggggcctggtcatactgttcctaaatagcagtttagtcatgaagttgacctacacgtctgttcatgaatgttttcgttttctgcattttccttttaattgccagcctagagatattggcatggtattttactggtggtgatgtccagaagaaagtaaaaaccaactcttatattttgtagaagtattggtttaaagaaaaaccaccttaactagaatcaaacaataagatcactttataactattgaattacttttctcaaaaagttctcagctctgtatttgttattttttttttaggttgtctaatgaataaagtttaaagcaagagtggcctatggggcagaagtcaatgttaactggtgatgtcttaggcaacagatgttttgatgtgaaacattttaagaggctttcattaagtgaagatataaatgaatacaagtcagttaattactatgatgattcaattaaagcagtggatcacagaaatgccatttcactaggaactaaattaaacatttggatatttcattagctacattggcaaacaattttttctttttaaatgagagacttacattacaatggcaagacagcagcataatacatgaactcatacattttcatatgttcagtatgcgtcatgctgttaatagtgacagaaactaaaaaatcatggttacagctttagaaaatataattcacacatattatttggatgactgtcatagttaatttccttctggtcaaataaagacaagatcaagatatgcgaagttgaggcgggaggattacttgcagccaagagtttgagagcagcctgggcaacatagcaagacccccctctacaaaaaatttttaaaagttggctgggcatggtggcttgaacctgtaatcctagctactcaggaggctgagatgggaggattgattgagcccagaagtttgaagctgcagtgagctatgactgtgccactgtactacagcctgggtgacaaagtgagaccctgtctcagagagagagagagagagagagagagagagagagagagagagagaagataatgtgtaaatgagaagggagaaagagaaaagtttgttctaatgaatgaaatttctgtcttctcttatacttctttcttggtgtctctcctcataatttgtagtggacattaaatgcaaagttaggcagtatctagcctcctgaaaaggctcatcctcatctttcaggaactgtctttctcatttaagcagaaaatgtgtgcattgttttcttcagagtatttgaaatctgtaaagtgagctagaaatcacaagcttttttttttttttttctttgagccacaccttgctctgtgacccaggttggagtgcagtggcatgatcacagctcactgcagactcaaactcctggggctcaagcagtcctacctcagtctctcaagtagctgggactacaggtgcgtgctatcatgcccagctcacaaacttcttttaatgctgggaaaaaaaaaaaacctgaagtgttttaaaaagtgaacagtagctatcctttataagacaatttatgatttgggaaataactccatattttcttcgaggcctcattttgaagtaggtggtgttaccatccttcctttgtgcctgagaaaacggaggctcgaagagatttggcaactttatcaggccacagaactaggaagggcttggataccagtctaaatctttgtgtgtgtatgtgtgtgtgtgtgtgtgtgtgtgtgtgagagagtaatagctttattgaaatatttacataccataaaaatgtgtttttaaagtgtaccattaagtgcgtgtagtatattcacagaattgtccagttgttaccactctctgattttagaacctttgcattactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgttttaaggttcatccatgttgtagcctgtgtcatcatgccattcctttttatggccaaattatattcccttgtggagagataccacactgtttaaatctgttacttgttgatgggttatttgggttatttccactttttgactcttatcaataatgctactatgggcactcacatgcacatttttgtgtggacctatgttttcatttctcttgggcagatatctaggagcagaattgctaggtcatatggtaactctgggcttaacatttttaggaaccagtcttaactttttgaaacctaaatattaagcttgttttattatacatttttgataaaagaataagtaattaaggaaatggatgaaagagggaaagaagtgggagcaagtaacaaaatgttgctcatgcatttccatgagtcctttggatcctttgatcaatcacagctcaccaaaacgagtcagtgcacaactgcacgtggttgccacaggttataagaatctcagtgcctgaacggacctggcaagtaatctcatctcatggtttactttcttaagcctttgagctgtttcttcaaagtaaaggttacccaggaacccaatggtaaagcagatagatacagagctggcatagctgacagggagtggggagaggatggtgctttggccctcctctccttcccccacccctccagcttgaaatctctgccctgtgggggaagctggaaaggctgttcaaagctagaaaggctgttcaacctgtgcatgagcattttcaagagactggaaagtaactacctctccaggcaatccattttttctccagacagttcagactgtcagttcctacaagcagtgaaaaatcagccgaagttgtgttccttgggtccgtagagaataggtttaatatcttatccatatattaggtcatcacatgtttgaagacaatgattatagttctttctcacatcttctagctcttaagacgtaattttagacccttaatcatcctggttgcttcatctacacctgtttccttttgtctgtatttctttcttaacttgatacaactgaatgtggtattccaggcatgttttctacacaaagaagattagaattggatatgtcacctcccttattccaaagtctatactttttttttttttttttcgagacagagtctcactctgtcgcccaggctggagtgcagtggtgcaatcttgcctcactaaaacctccgccccctaggttcaagcagttctcctgcctcagcctccagagtagctggaattacaggcgtgtgccaccagcctggctaatttttgtatttttagtagaaatggggtttcaccatgttggccaggctggtctcgaagtcatgacctcaggtgatctacccttctcagcctcccaaagtgctaggattataggcatgagccactgtacctggcctatacttctaataatgcagcctaaggttatatagactccatttcttgtcacatcacattattaccttttactgattttcaagtaaaattcttgtgtactttacatgtactatggctaaatcttttcttaaatttaattaccttttttttttgagggtaagtttcctcgaacaggcagagccctatcagattacaacaccattataatctgtgttgtaatgctataaataatcccagcacttactaagatatttcagcattatagtaacattgaaattgaccattgccttacagggttgtgattgtggttaatagccttttttcttcttgccttggaaggtgtcatgagagaattatcagatgccctctaaggcctgactggagcgtatctgccatgtcccagatctggcctggcttcttctcctgcaggtgctacttgttagtaactacagcgggtcgagtccatgggacctgcccagtcaaattttgaaatcactataataatcctttgagcgactgaagtttattttttctagttttgcaatggaatgttgttttaatttctaaacatttatattttggaaattaacaataatttatttaataatcttaaacatcttttgacatctctaatactgatgacattctcttaactatgattacagcaggattttcaagttgacacctcgatggttataaacaagtagttggatttaaaaggaacacctgtaaggaaattatccaaactcaacgctccgaagtattttcaggcctcttttgcattctcatgcagtgacagaagactgactgaggcattctgtgatagcaaaatcggaggaaaacgctttcatggaaaagtgcaaagcaaaagcacccacgctaagcgagaatttctaattagtatacttggtgctccagccaggaaggaacttatagccaaaccacaaccatttatcacattataaacaaacccacgcattttggtggaaaaaaatcacaaaactgtgcttaaaaagtaaccattaattggttattgtccatttctgggatagtgtaaaccttttcacatattctcttaaaaaacattttagttgagtggaggttggataagagaggagaaataacatctttgtttctagtgttacagcttgttcatgctataaaactagtagcgtgaaaaccttcatcatggataacattgaaaacggaacatgaaagcattgctctctctagtaagacagtctctccaaggacttaaaatcagtggcattttgtactccttacaaaaatttctttcaggaacaactattcatccttaaaattttatcaagctcattaatagagggtttctagtattagcaaaatttttaaacaccttcagaagcattactaattacaaacaaaaagtgtgctgtaaactctaaaagctgtataattattattgataccacccgtcacccccagcttcatgtttttctcactagacgtttggcacatagatttcatttctgctgaaggctgcacattcattttaatctggcccaggactgggggtgtgcgaaggtgtcagcaggagcaagtgcatactctctttggtttactttttaagaaatacctcttcagaagagtttttctttctttaaaggacttgttttttttttaagtttaattaattatttattttttatttagagtcagggtctcactctgttgcccaggttggagtgcagtggtgtgatcatggctcactgacctcgaacccttggactctagcaatcctcacacctcagcctcccgagtagctgggactataggcatgcgccaccacacctggctaaattttaaaaaaattttttagagatgcagtctttctttgttgctcaggctggtcttgaactctcctcaagagatcctcctgccttggcttctcaaaatgctgagattaagcatgagcccctgcacccagctaatttttaagattcagtttagttagatacatttccatttttgtttactctaaggttctacctttactggcaaatactgttggcggggaaaaccattttttgcagagtactctcagttgtgtgttaaaatgcagtcatttatttattctgccagctttctggaaaatatttaaactctctatctttaataaaccatccccacagtgtaggggcaggttcgacctatagacttgggtgatgcctgagggcacttactccaagcccagggcctgcccgaggtagggagtcttacaggagaccttcccacctgccgaggccctgctgtcagagggaggggaagcagaggtgactggccccctgaggccagcggccagatccatgcatttatcatggtgtggtccaggactggtggtacccttcactctgcaaagcccctgtaagggagacccaccgtcctggactgcagattcttcccacaaataacctttgaaggacaatgggcagcccacagttaaagataacaaggatagaaatggttaggcgaatattcatggagagacttgagtccgtttggcaaatcgggctgatttccagtgaatacctacagtgggcgtaggacaattaaacatgtcaaaaatgtagtctcccctgtaaacattagattctcctagtaattggccgggcacggtggctcatgcctgtaatcccagcactttgggaggccgaggtgggcggatcatgaggtcaggagatcgagaccatcctggctaacacggtgaaaccccgtctctactaaaaataccaaaaattagccgggcgtggtggcgggcgcctgtagtcccagctactcgggaggctgaggcaggagaatggcgtgaacccgggaggcagagcttgcagtgagccaagatcgtgccactgcactccagcctgggccacagagcgagactccgtctcaaaaaaaaaaaaaagaaattctcctagtaatcattttagactcttctacccactgccccatatctcagttggctcagtggattctgcaccccaaacgtctcatcatccatcccttcctccctggctcgggccctcatcagttctcatctaggctagggttgggtttggttttggcagcagacctaaagcagtcttcctaactctagtcttccatccgttcctttaaacaagcactcaagtactcacagcgtccattattacactgttttaggggttccagcgaaatgcgaggatgacatggtccttagccttaggaagcctaatttgtttctcaggagctaaacatccagtgttattttcacactcacttcatgacaacagtgataggttgttctaagaagtgtaaggaacaatggtagggtattgcagcactggggggcatgtatcagggcgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttgttttaaaagatcactctgcttccagggggagggcaggtgggaagggcagtccagggtggaggtaggagggtagaggtggggggccatggcagtaacccagggagaggcaatggtgattcaccctgggcggggtgttgggagcaagacgcaggagatacttagtgggtaacatcctgtatttacattaagagtggggagagggcagaatcaaggctgacgcccaggtctctgatgcctgcaactggagatggcaggacaggccagggggcctgtgcagagatggcagtccaggccacgggggaggtggtttgggcttgtggggtaggaggacatatgggatacaagctgaggtgctgagcaggctgtcggtgaaggtctggagcccgggagatggctgggctggacataacatttgcgagccatcagcatccagatagtaatgggatccatgggcaccgatgagctcacccaggggaaattagacatttcgaatgtgcctcctgcaagacagatccaggcaaaatggcctcctgtttaaaagctgacagcagccctccctcccactttagcacccagggccccacttatcttcatccctgagtgcccccaggtgcccttccttcgtcggtggctatgtggtatttagtataaacctctgtcatcatgattatcccagaggcctgtcacggaggtttattttcagtctcccattagatataagctcctctgggcagactttcctgggatcgtctctgtgtcttttgcacctcagcagtgcctggcacgtggtgagtttcctggtgaaaggtggttgaatagattcagggtccatcttatttatcttatagcacctcctcaaacacacgcaccaggcgccaccaggcaccatgccacacatgtgacaggtgcatgccaaataaagcacgcccaccgcttccctgtgtgcttgaaacaacgtgtatcaatgtgtatagtatataccacatgtgcatataactgtatgtatacctgcgtatctacgtgcattatacacacatgcacacatgtgacattgaactctacccttcagcaaagaactggtagacttagacattcagaagagaaggctttccagacgagggaccttattggtagaacccagaaacatatgaatgcaggcccaggagactggcttagtacagagacaaaacttgccaccacagttgctgctgaatgcctctcgctagacaccgcttcactggaatcaataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgcagcattactgtgcactttagccccagctgtcttcatcacaaacacttgaaaatccttaggaatagaacttagtgatgatgctttatctactattgagtcgcttatgcttaccaatcctgtatgcaaaatgtggcagccgctcccaggggactgtatggagctataataaagataatgatctgttagctcggcttcaccgaattagtcctttagaaagtaattaagcaggattgcccacactccactgctcccaaagactgaaatctggcttggtgtgtcatttctttgccttccttgaaaatggccttttattgagttgatataatttaattatataaaaatacgtgttcagattgcatcttgtacttaattatatcttacgccacggagttatttcccagccagagcttgtgctgttagaaggtggggtccatgtctcattcatgcgtgtatgtgtgtgtttaggtgcaggagaggaggggagagaaatgctggctttaaagagtgctcaccaagcatcaggtgttgggctgagcatttttaatgtattcttttgtttaattctcacaacacccttttgaagtgggtcctattattgtctccattttgaccgacaaggaaacagaggcccaaaactttgagtaacttgttcaagattgcctggccagtgtgtttcagagctggggtttgaagccaagcattctggctccactgtccatggtatactaagtactcagttatgctcgatgagtgaatgatgggaaaaaagatgggacagctatagacctgaaagggacttaggagattgttctggtctgcccttgcctgtaggagaggccacacatggtttacaagtgcagagcaaaggcctttcccttggattattggaggagtctctgaacagatttccttgtcttcacctgtttttcttcaaatcctacttcttcagcacttttaaaaatggaaacctcatttatctctgaattgcccagcatcccccggaagttccccatgactcttggggttcagggccgattctgggaaccacttgccacctgcttccctgaccctttcctcccagggccctggatgcagccaccctggacttctggtagcttctgaaggtgccaggctgttgtgtacaggattccacatgctgagcgcccttgccttccctgcagcgtcccttcctaccccttcttcacggagccgctcccttgtccttcagaaccctgctcccatgccacgggaaacctcagggcaggtagatgtaggcgcagctcactgggtgccccttaggccccaggccacgtgtctcagggcatagccagctccacttaaccgaccagaccaggaggacctgtaggatgtcattctggctcatgtgactcagtgggctctcagtactagtttgttgaacaaaagagttcagagtggaaatattaaatggtactttgagtcgtgcctacttaggacattttaacttttctctgttagcagcccgcaccaactgctgtgacttagtgtttgtgaaactcttccgtctttctgttaacagttgtagttctttcagtgtttcatcagcagccatattctatttacttattctctttcttttcttcttcttcttttttaaatcttttgaggtagggctcagtctgttgcccaggctggagcgcagtgatatgagctgggctcactgcagcctcgacctccccagcccaagcagtcctctagcatcagcctcctaagtagctgggactataggcacatgccaccgtgcccagctaatttttttatttttttgtggaaatggggtctcgatttgttcctcaagctggttttgaactcctgggctgaagtgatcctcctgcctcaacttcccaaagtgttgggattacagccatgagccactacacccagccctagaaccctttttttttcaaaaaaaaatttaatcatggtaaaatacatataaaatttagcatcttacacatttttaagtgtacagttcatggcgctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacaatagtttcatgaagttacagaatcctaaactgaatgtttaactaaaaggttcaaagccctgggcaagaagtgggataattacctgcacatttgaggctgtcagaacgcctgaagatgtgtcaccggatcacacccacgtgcattacaagcagccctgctcagcctcctgtgtaaagttttggtatccgatctccagaatcttttttttttttttttttttttttgagacattcttgttgcccaggctggagtgcagtggcgttaatctcggctcaccgcaacctctgcctcccgggttcaagcgattctcctacttcagcctcccgagtagctgggattacaggcatgctccaccacacccagctaattttgtatttttagtagagatgaggtttctccatgttggtcaggctggtctcgaactcccaacctcaggtgatctgcccaccttggcctcccaaaatgctgggattataggcatgagccactgcgcctggccagtctctggaatctctaatggaaagtgtgctccttcccccaagcaagagccagtacaagaccactctcaagaagggtagtgccaagtatgaggagacagggcatggattcagagctgcccttcacacccaagcacagcaacactggctgctctgacaagccaagaagggtgacaagtgtctaagctcttttaggaatggagagctgggaaaaaatttagagctgtttagaaaaatgatgaggggcatatgtttgctaaagaaatttcatgacatatgccttctgatcgccaataacatgcattctctcccaattagctaagaatctaagaagagaaacagcagatgcaggacccgggatctaggaaggatctggactggagtcttggaatatctctgagtttttgtttttttttaaggattgcttttgtacgtttggcaccgtttgatgccgtgaacgcctgattggagcatctcatttgcaggactgtttaaagagacaagcaggcacaggctgcacacgtgcagacgaataatgaactcttgagaattagcacaaaagattacgtgcattctttcgtgatcctctgtaatctaccaccaaattactttcccagagttggagtgcataggctttggagacagacacatctgggttgcagccttgattctgctgttcaatgaaatgactgtgtgaacttggataattacttattctttcctggcctcagtttcctcagctctaacaaggagagctggctgcaaggcgattctagagagtcctggcaggaagcaatggtgccctcaatggccaatttaaggcgattgtgacaaagtcactgttgtgaaggttggtgcaaggtatagggagaccacaagggctggggtagtggccaggactggtacagcaggcacagtcccaccctaggcctgaaggggcagaggggcagttaccagacctgggttcagagagggctgggtggacagagccgccagacaggagctgtgacagcaaccctaccccaggaagaaaccctgacctcactcccctccctccttcccctccactgctcctacccaaggggaagcctgttgatgcagcccacgcaggggagagagggtggagacggggtctgcagggcaggcttgagagctccagcacagcgttgtctagaatcaagatgctaggacttagtagtaagtgtcaccttagtgttgtcttgatggttacagctgggttgacttatcctcattcctgatgcctagtaggtatctcataaatgttagatttgtggtcttaccacacccctctgcttactgtgtgccaagagtttccaggactctgtggtcatgctttatcagtcacgagcccctcctttttccgtatttaaatactgttcatgccttaagacccggcctacagactatccctggggtgaagtcttccctcatctgtcccggattacttggtctttcctctgcgtttctgaattatgatacatacccctctgatcactgctggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacggtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctcttctccctcaaagcacaatctgctgtatgttaaaggggcggggaagctgctgactttgcagtagcgcatacttactcacgcaattttccattctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaagctgtgaaacccagatgttttttggtaacttgtttgctagttggatttggcctgatctgaaatcatttgatgggtggggagaactcctctgaattgaaacatgtggcttttaatcgtttgtgttcatttcttttagtgtgaaagttctgcttttctgtagaggtatttttgaatgtgactatgggtcttgtcctaggcccttctgggatattggctaatgtatggtgtatgccctggacttccgttttaaagtctgaatctgagttcaaaaacatttcaggccccagggatttgaggaagggtttccagaccagtataaccagacagccgagccggccctgtaccgcgtctggttcctgggtggttcctgctgcaatgcggcccagtcagggcactgctgctgacttgtatctgcggacactccccagtgtttgagtgatgtttacgtggaagcctggcgtgtaggaagctggcgcccctgggggaactgcaaggccattttacagcattcacctgtcaccgtgtccttcagaaccagccagatgctacagagccaggctgtaccagagtccaggcccatgaaaacaaagttcagggagactctgttgactttgctaaattcatgggttccttccttccttcatttctttgttcaacaggaatttatgtatctgccataagaagacctgtgcttggcttgtgaaaagtagcagtgacacttcacatgagtgtaacatctgcggtttatggttttgttgcagtgtttcatttcgtcctcgcaaccattcagtggaccagctggtgttggcccttttcatagatgaggaaactgagggctaaatagcttctccacatctgcagattccaatcctcgtggcttttcctgttctgcggctttcataggccctctgcattatttgttaagactcagctattttctaaccccaacccacttgaagcagtggctttttcagatacccgggacaaatcacgtgaccttgtggctcagttttctatgccataaagtgggattccttcctaatccttgcaactcttaagtgaaataatctatgtgactgctttgtgaattgtgaaactcaatctggtgactatagttaataataacatattacatgtttcaaaattgctaaaggagtggatcttaaatgttctcagcacaaaaaaatgatacatatgtgatgtgatgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataataggggttttttttttgtttttttgggtttttgttttttgaaacagggtctcgctctatcacccaggctagagtgcagtggttgatcacagctcactgcagccttgactcactgggctcaagtgatccacccacgtcggcctcccaaagttctgggattacaggttcgagccactgtgccttgtgttgagtgtaacatttgactcctcaaagtcttaactactaacagcttactattgaccggaaccttaccaataatacaagcagtcgattaacacatattttgtatgttatatgtattgtatactgtattcttacaatacagtgagctagggaaaggaaaatgttactaagaaaatcaagccgagttgggtggctcatgcctgtaatcccaacactttgggtggccaaggcgggaggatcacttgaccctaggagttttagatcagcctgggcaacacgataaaaccctgtctctaccaaaaaaaaaaaaaaaaaaaaattagccaggctttgtggcacgaacctatagtcccagctacttaagaggctggggtggaggattgcttgaaactggaaggttgaggctgcagtgagccaagatcacatccctgcactccagactaggcaacaggaatgagactatgtctcaaaaagagagagagagagagaaaggaaggaaagaaagaaaataaagaaaaatcataaggaagagaaaatacatgtactattcataagtggcagtggatcatcacaaaggtcttcaacctcattgtcttcacattgaataggctgaggaggaggaagggttggtcttgctgtctcagaggtggcacaggtggcagaaaattcctgtgtaagtggatctgcgcagttgaaacccacagtgttcaagagtcacccgtacttatttctctactctcctgtctgacatctcaagagctaagcccccttggtattcattcatctttgagaactctgcattgcctagtttaataggtgaacagtacgtgtgtgttggagtttgtacagtggggagatgtattgctggtaattcagggggttagggttgctgatgcagtcagggaggcctgactgtgcatgcccagccccttcatcaccaggcgccatgtgggtgcccaaccaaagacattcatgaggctgtctctctgtgataacgaaacagctggacatacactgagaaaggaagtcagccaaatgaatattttctaacctaactctaaaaaggtagatgccaggcagcatccaggtgacgatgcttttttgaggctgacatagtggtacacagcattgaggtgctgtcagatctcttccctgccgtccacctcccagtgaccattcctcggctgcacaatgcgcctccccacatgcattgtcccacggccctccctgtacaatcggctcttcactttgcctggctcagaggtgtcttccataccaaagaggctcagagtgtcaggatttaggggaggttggaagcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaatttacttttctttagctgaacattcttacgtggttttaaaagcaagtaaacagataaagtgtttctaagtgtaataattctctttcctgatgcatagctaacaagcagtgagcaggcagaggggccctaaaccaaaggctctctcatttactctgtaaaaaatctgttccacactgcgtaacctccacatccttctcctaaggctgaataaattgggtgccaccctttgaaatgtagtactctgtttggcccaggaaccgtagttagccgtctttcttgaggaaagctgattaatcttgttttgccaagcagaaggattatgggtatggctgaaccagttttgtacgctttgaaatatcagccctgtcaattttgtgtttctcagtgagggaggaacaggggacggtctcacgcaagagaaatcctggcttttgatttaaggaaaaaacccccagccacttagctttttttctttttaatcattatcttcaagacaaaaattcaaataccctaacatgtacaattatatagtgtttttgttgtagaaaatatcatttggtagattatcaagactgacaaaaataactatctttacctattaaaaacgattgagatggccaggtgtggtggctcacgcctgtaatcccagcactgtgggaggccgaggcagaaggattgcctgagcccaggagtttgagaccagcctaggtcgcatagtgagacccggtctctataaaaatttagccagttgtggtggcgtgtgcctgtagtcccagttacttgggaggctgaggtgggaggatcgcttgagcctgggaagatagttgctgcagtgagctacaatcatgccacagctctccagcctgggaggcagagcaagactctgtcttaaaaaaaaaatttttttttaactatagagatggaggaggactggctattttgcagatcattataccaatcctaatcaatagctagttatcaacaatttcatcaactcaattggaattgagacttgagtttagacaagctgaatatttatttttatgctccagaaaacctgacccaagaatcccttttacatctgccaggaggttgctggtgcctgggtcagctgcccggagcacactgtgcctgcgtggagacctttcttagcagacgaaggccagcagcatcagagcagtgcaaattgcaagcccaagatctaaaacagatgatgaagagctatgtatttgtcactgtatccttccacggtgttttatgctattgtaacttcaagagttgacacagttctttccccaacactaaaacatgaaagggtcaggtagagctgttgccattttcatggaaacctagagttgtaaaggacctcggaagattcaggactagatttcatcttaaaagagacattgaaaaccagtaactcaaaaggaaggtcaaaggaacttattttatttttatttaaatttttttagggaccagatctcgctttgtcactcaggctggagtgcagtttcttggcatgatcctggctcactataatctcgaactcctgggctcaagcaatcctcacaagtagctagactacaaatgtgccccaccaagtccagataattttttttctaaattttgtagtgctgggatcttgctgtgttgcccagaccagtctcaaactcctggtctcaagtgctcttcctgccttggcctgccgaagtgctgaggttacagacatgagccactgtgcctggctggaaagtattttattgtaaagcattttaaaattaataggtcatgaaactataaaacaaagaatagattgcataatggattgtgtgaaaatacaagttaaagctattttacagagcagttagaggcttgtctcatacctcatctgaggctccagtgaatcccaccccaaatggaccagttagcatgcagccaataagacatcttcctgggccacagacaggtcctcttgtgcaggacagctgtcatgcacatggggctcaatggatgttattcttacagcgacctcgtgccaagcactatgctagcatatatgctcttcatttattgcagtaatccttggagggtaggttggattaccttggatttacagatagaacagctgagctcagagagggaaatggaattactcagggtcacacagctagggaggggcagagccagtattcagcctggtttgtgtgattccagaaccttcctgtggagcccatactcgtggcttgagcattgcctagtcattttgatatctgcgagcttgagtttccccttatgctaaaactgggatctgtgaggcttggcttttttttttttttttttttgagacagagtctcgctctgtcgcccaggctggagtgcagtggcgcgatctcggctcactgcaagctccacctcccgggttcacacttttctcctgcctcagccttccaagtagctgggactacaggcacctgccaccactcccggctaattttttgtatttttaatagagacggggtttcactgtgttagccaggatggtctcgatctcctgaccttgtgatctgctcgcctcggcttcccaaagtgccaagattacaggtgtgagccactgcgccctgctgaggcttggcttctaagaactgcacaccttctaatagtataatgatatgcccccttgttgtgtcatgactaacattgatttattttagagaaaattgtaattgatctatttttcttctgcaaacaatggtttctttttgactttgttaaaatgaagatgaatagctttttattttagagagccaaattgtagcagctctttgtaaatactttctgcattctagaaaaacaactttgattggatggcagaactggagattagtagaattaggaaaatttctgagttactctttgttgggtttttgtgagctaaggggatttttagggtgtttgtgatgtttctttatgacttgaaaggtaaattgcgtcggtgacatcagccttgattctgtcgtagagatgcttacgagatgagcatcttgtgtcatgctcagaggtaaagggcggctcctggaagatagaaatctgacaggggtaagaatctgacaggggtaagaatgtggagattcttgtgaagcaagcacttcagttacggcagctgctgttgttcagagcacagatgtttgcacattgttttactttctagtcactggctttcatcaatggaatccttccttttggaggattattattgatgtcaaatgttgtcagatgaaactcaaggcatggcctggggtacctctgtggtcagagagatccgactagacgtactttcactcatatttgactttattattttttttagacggagtctcactctgtcgcccaggctgcagtgcagtgacatgatcttggctcactgcaacctccacctcctgggctcaagcgattctcctggctcagcctcctgagtagctgggactacaaacgcccactaccatgtccgactaattttgtatttttagtagagatggggtttcaccatgttggtaaggctggtcttgatctcctaacctcaggtgattggcctgccttggcctcccaaagttatgggattataggcgtgagccaccgcacccagcccatgtttgatttgattcccacaaccacagtctgtctgtaggcagataggcctcgtgctacagataaggacatcaggagcttagaggctggatggatgcttcactcagctcgcctggtgacagtgggattcctggtccataggtcttcttctgacccacattgcttcttagtttggtccaactttgaaagttgcatgtttcatttgaaatgaagaaggcctaagccagaatggtacagctgtcacatccaagtgtaagatccatttctaactgccagaggcatggcagatgcctcagagaagggaggagtccatttggatggagctgtgtgtggctgacatcttcctactccatgtccttcactttggcacgtaggttagcagttctcaagctttttggtctgtcttgcgtttaaatggctgttctcccaggcttgattttgtaacaccgtgctttgattccttgagaacattgattctctgagttatgcagaccttccaaatgtgacatatttcattatacaatatcaaaaaagcacatgggttaatatcaacccccaatgtcatcaaaacagcatgtaggtgttggggagctgtcaggcttacagaggctggtacaagttttccaaagttctttcttttttttctggaaagctcaaatttatccttggcagcaaatgctgttgtttttcctggagtgacgggcttactacattcatttttttgagaaaatgattatagaacactcaggtgtgaagaaccctggtttgtccatcagttgttctttcaagtgaaaatgatgttccctcagaagaagctcacagcttgactgcacagtgctcagtttggctggtgtgcagcaaaagtgcttcataaagagacctgtactcaagggttgagctttaataaaattaatattgtttacagcgtcatcaaaggcctttgtatatgaacttggcatctttcttgtaggtggcagtgaagaagagcacagcgacgtggtgcctgtcccggctggtgctgaggcagcccaggtgccgccaccatggctcccgcagcattagtgcaggtgtcacacaacgacaaaggaaattagagcttggcattgttaaggacgtaattctgacctcagggacttcctgaaggggtctcagggactcaggggtctgtggaccacacttttagaactgctgctgttgagtattggaaagttccccattcggcacattccttgagggccgactctgtgccaggtgttgtgctaggtgctggggatactcagatgaacggcacagtccctgactgcaaggagctcacggtctaatggagaagggggtcaagtaaacagatgcttgcaaaaccttctcgtaagtgccatgatcacagtaagcagaagggatgctctgctagagtgtaggtggagcccccagcccagcttggtattctggtggtggtgataaggggtgtttcctggaggaagtatcactgagctgagtttggaagggtagaagtagaagtaaagccagttaaagaagatgggggaggtgttccatgaagatagagtggctcgggaaaaggcttggaagcaggcgaaagtgtgcagtgttcaagaaaccacaaatagttcagtagggctgcagtacaagagttgggggtgggggctcagggataagagggggccaaagaagtatctggaggccagatcccaaagacaatggagatccactacaggagtttagcagggatgtgaggtgatcaaatctgcactttggaaggatcactcagacataaagaagaggaatgggatgcggagtgatgagagtgatggataaaccagttgaggttgttgccggagtccagaaaacaccacttaggcccaaaccaaggaggtgacaatggaggtgaatgtgtggatatttagaagatatttaatgtcctatatctgcagatattcgaataggcaggatttgatgattgattcaatgtagagggcaaaaaatatggaatcagtcaaagatacaccaagatttgtagattgatggctgcacggtggtgctttcatagaggtgaggggtgtgggaagaggattagaggcaagatgaccatgcgaacttcatgtatcatattcacacacacgtgtgcatcactctatcttcaggcagaagtgtccagaaggagtcagagctggagcttgagagggttctggccttgaggtgtcagctgaggagtcatcagtgtaggtcgtggttgagggcccccttgttgatgagatcacccagaaggagagtgtggacttgccgactatagtcacagggctcaagtcaggagagaagtcaaagcaagccacgggttttaggaggagggaaacctgaggcctggatcgtcctggtccttcacgtctgcagaggagagcagagaagaattttaaattattaactcctcaactaaactacatatcgtcagaacatgcttttcaaattaatttaattgttgattttatttagttttttagagacagggtctcgctctgtcacccacgcttcagtatagtggtgcaatcatagtttactgcagccttgagaaactcctgagctcaagtgatcctcagcctcctgagtggctgggactgtaggcatgcaccaccctgcttggctaagttttttaaaaagttgttttagagacagggtcttgctatgttgcccagattggtctttgaactcttggcctcaagtcatcctttcaccttggcctcccaaggtgtggggactacaggcatgagccactgcgcctggccagaacatgcttttaaatgtaacatactaaacatgatattttatgagaatacagcctatataatatacgattttgttcctgagctcacacagactttaggtctgtaaaggatggtaaaaataccaattacagtttatatttccttttcccaccagaacatttttattttaaaagtagggtggtttttccttcccatctatggtttcatagttctcggaaatgttaacccttctttctctatacgaataaggtgtcctggtaattttgcaagtgatgatttccattatggtgggtggccacgacggaaatgatgttagaagtgccagcgtgcacgtgaagtttagacaagatctgttccttggccctgcggtgacgggaagaggggagatggaggtgttcactctcgtcttagagcttggtgtcaggaagctctgtctggaggtttccctccgtggtgggaggggtgaagcagacatgggagggggaaaaggcgggtctgcaacaggagcccagcctctcgcaccgagcatccctcagtgaagcgcccaggcccacaccacgcagccagcctcactgggctgggggagggctcacgattactttctgtttctctgcgtttgaaaatcttgtgtaatgtgcttctgcacttttaaaatcaagaggaataaaataataaccaaataaaatgactcttagccctgagcttgtgacacacaggcaatttgcttatcacctaggccaccaattaatagtacttccctataactcagggcctggggggttccaatggaagagctgagcatgtctggaggatgttcctgtctgataccagccatcctaacttccagaatataggcaacttggcagcaagagttttaaggttattatcaacctggtatgtggttgtggaagttgatatatctttacatatttttacttaaagctttttagctctacctatacatgggagcaggggctaacacagtattttgttttattgatatatttttcgttttgtggttactgaaagtgaattgtatggcacgttgctctcacttgtaatcagtgacggtgtagcctaagaaacctggtcactcaactgcattgctcagcggagaggaagcttctgtacgtcttggaccttactattggtagcccgtgctcagcagctggcctcttgcaaagggaggactattgaggatgaagagaagaatcttgacatctcaacctcttctcaccctggtttctgcatcatagttttaccatttggttagaacaccagttcaatgcacagtcagatatacagtgcaggcaaaatacgaaaccaaagatacagagtaattacttttccattatcccaatgtactttttctgtgagcaaatgaattcctaaccacagcttgtataccggtgtcttaacgtcaggtaaaggatccaggggcaggttccaaattgaagctatattttgctttagttcacctccattaacacttaggtccaagtgtcgtctctagtcggttgctgtaaactgaactgaagtgcctccactacaaggagatgaggaaaagcatggaaggaggagccatgtggtgggaaggtgcacggaggcccggtggcagatttcagctgagatttttcaaaagcctacacactttctaacagtggaaccacttgccttagaaagtgcccgcccccaattgcatttgaaggttcaagcagaggctggatgatgcctaacatggttattgcagcaggacttcttacatttactttttttttttttttttttggagacagtgtcttgctctgcccaggctagagtgcagtgacacggtcatagctcactgcagactcaagcacctgggctcaagtgatcctactgcctgagccgcccaagtggctaggaccgtaggcatgtgccaccatgcctggctaattttgttgttgttgagacagggtctcacttggttgcccaagctggtcttgaacttagtcctcctgcctcaacatctcaaagtgttgcgattacaggcttgaggcaccacgcccagcctcttactttaacttttaaatttttcctgcttttatatagagctttttaaaatttgagcctctccaagccgggcaaagtggctcatgcctataatcccagctgttgagaggctgagacgggggaatcacttgaggccaaaagttcaagaccagcccgagcaacatagcaagaccgtctctccctcccttttgtctcttaaaacaaaaatgcctcccagtagccttgcaaaacaagaccattatccatatgatacaggtgaggaaattgggtctggctgagtgacttgttcaggataatttgactccacatcttttgacatccagggctctttccatttgtcacacctgctgccttctgctccaggagaagcagattgtgccactgcactccagcctgggcagaaggaaggggacaccggcccttttgactctagagtgtctgtgccatgtgacaacacatgatgaaatggaataggaatggatctaaaaatcattgagattaggatctacagatacatttctacgtgctaatatgtcggttttataatgtacttctgtggctaaccacagaccactggcagggaatgtatctgtggttagatagctagagtgtttgttcactccctatcaggagggcagtaaatcaagaaggcaggttgaagcacagcttcaaatgctgccacgtggctgtggaagactgtggaataagcagcagccagccagcctggtgtgtgagatgagggatccgatcggttgctcgtgttggaacaaaggcattttgcagccctccaggtggttgcagatgattgcaaggggaagctctgatgtcctaccagagggcaggttgcatgtatcttcaatatagttaggagtccttagtatcctaggacatatgtttttttttagttccaccttttgagaccatagctccatcgttaatggtgtttttgaataccaaatgcaggcactatatatgagaatacatgtgcatgtggctgtgtgtgtatgtgtgtgagagagagaggggaaaccctggtaactgatgaataatcatttaacaacactcagctgtttgaataacaatagtaataattctttgtatttgtaagctccattcacagatatgatttgaatggtaatataactagggttaaaaatcattattgttctcaccagtgctctgaggaagttgagcccccagctggaggatgagggcagggaaataaagatcttgtactgcaccttctctgtcttcctttgatttatctttttcatattcatttatattatttctccacaccccctccatctctctcattttctttcttagcccctcttgtaggtgatacctcttggactgggacttgcagagccagtgattgtgccaagaaatgccgtttcttttttctttattatccccatgccccacatgaaaggccattgaacttaaacttgcctgcagggggtggcagtagaggaagcccacttggaggggctttgccagccaaagccacactcctcctttcttcagttgcgtttcttatttccatttctttggttcccgctcaggctgctgaagcgtctctccagtcttttcctattttagcacgccttctttttggcctgctttgccccaccagacatgctgttgtcaccagtccaatccatctgtgttttctggatacacactgggtgtcaatgctttgacaagtgtgggttccagcaagcctaagcgccgggccctacagagccatctcctccgggaagaagacccagccccctgtgcccttctggtttgagatgcgtgatcctgccgtgccctccggttccagggtggggtgggacggccagcttatgatgtgtaactagctgcttgtcgtccagactcagttgcttttaataaaattgccacttaagagaccctgctgctggcagagtagcttcttttcttctgcttgtgctagttcccggctcacagcagcatctgccctgcacgtgggtggtgtcggccttgccctggccgcactgtggctgtgtccccacttagccatcagaaccaggcatttccagtggagtgcagtgttgcaggagggtcaccaggcttagtgtgatgaggcctggattacacttcgggtctggacgtcctctctgagcctgaatttctgtgatctataaaattggataaagtatcaaataataccgatcctaacagtcttgatcattgtagaaacaaatgaaccaatgtctggttagagcctggaccgtgaaagtgctagaacgtgttcattcttcctgcgtagattgagtgtctccagggtgccaagcccagttctaggctctgggaaagagcagtgaagacaacaaaccaacaaaacaagtcctcacattctagtgggagagggacagtgggcaagcaagcagataagtgaacaagagagttccctggagggttgagtatggtgaagaactaaaacagtgactgaagggacagagtgtgtagcctggctgtcacttggtatctctctacttaaactggagtcaggcgccatttcctccaggaagctttccctgattcttccaggctaaagtaaccacagctgtggtgcattgtgtagctactaggccccaaggactttcccatgcatcatctctctctcttttttttaagatggagtctcgctctgtcgccaggctggaatggagtgccgtggcgcgatctcggttcactgcaacctctgcctcccggattgaagggattctcctgccttagcctccctagtagctgggattacaggcacccgccaccatgcccagctaattttttgtatttttttagtagagatggggtttcactatgttggtctggctggtctcaaactcctgacctcaggcgatccacccgcctcagcctcccaaagtgctgggattacaggcgtgagccaccacgcccggctccatgcatcacctctaatcctcattctcctctatgtgctaagcgttattctcaccatgtttcctctgtgtcttatttatttattttttagatgcatcacgtttttattagggaaatgtaaatcaaaatcacaataatacagcatggatccctgcatacacatactatgtacacacatatgtatgtcagtaattggcctcggaaatgcaaatcaaaatcacaataatacagcatggatccctgcatacacatactgtgtacacacatatatatgtcagtaattggcctcaacacagtaagtagcttttcaggtcttatcagtgaaaatttcttttttttttcttcttgtaaaaatcgctttaggggtacagtgcaggtaggtttgttacatggacatattgcataatggtgaggtttgggcttctggtgaacctatcgctggaatggtgaacactgtaccctgaacagtggaccccatagtgagcacaataggcgattttcaatcctcccccctcctaccctccacccttttggagcctccagtgtctattattccactgtgtgtccatgtgaaccactgtttagctcccacttatgagtaaggacgtgcagtatagaattttctgtttctgagttactgcacttagaatagtggattccagttccatccatgttgctaaagaagacatgatttcattcttttttatggctgtgtaatattccagggtcatttttatttttttgagacaggatcttgttctgtctcccaggctggagtgcagtggcacagtctcagctcactgcaacctctgcctccagggttcaagtgatactcccacctcagcctgacaagtaactgggactacaggtgtgtgccactatgctcggctagtttttgtattgttttgtagagatgggggtcttgctatgttgcccaggccagtcttgaactcctgggctcaaatgatcctcccaccttggcctcccaaagtgctgggattacaagtatgagccctgtgcctggccaccacattttgtttatccagtccttcattgatggacacttagattgattccatgactttgctgttgtgaatagtgctgtgatgaacatgtgggtgctgatgtctgtttgatacaatgatttcacttcctttggatagatacccggtagtgggattgtgggtggaacgtacctcagagagatcaagctactgcccgagatcacatactatcaaggggcagaactgagtgtcctaactcgagactcagccctttctaccacatctccttgtcttctctgtcccaggccttatgttcacctctcttcaacctcaccacagtctggaaatttatgtttctgtgtttttcctgtcagcctctgaactcctgaagggctaggaactgttattgtcagcacctggagccacactaagcgcttactaggagtttattgcaagtttactgagttcataactagccccagccccttgccatgtatttccacttagatgccacagatttctccttcagagtgcttgtagactgcaaagggagcagtcgaggtgaatatgcttggagaggacataagggaaggttttttcatgtaaacgaactcattttagatgtaaggcatcacttttcagtgaagcagggactttttacaaagtcttgcctctgaactttacagtaagcaagccgagatccatgcttaccactgcaagaaaactttggtgggccgttgtacaacagtaggcaattgtgttggcttaatgtgagttcttgtgaggttgacctttgtatgttttgaaagtctttagcatttaaagtctgcttctgtgcattgatttttttttttttttttttttttttgagatggagtcttgctccgtcacccaggctggagtgcagtggcgtgatctcggctcactgcaacctcctcctcccaggttcaagcaattctcctgcctcagcctctcgagtaactgggattacaggcatgtgccaccacgccctgctaatttttgtatttttagtagacacagggttttgccatgttggccaggctggtttcgaacacctgacctcatgtgatccgcctccctcagcctcccacagtgctgggattacaggcgtgagccactgtgcccagccctatgcattgattttgagcaagaaagggataggactaaattatgtggatgcactgtacaattcccaagaagggttagaattctagtcttgccaactcactcctccaagggcccaagtttgatcaccggaggattattccttaagcagcacgccacagccttctgcagttccccatgggcctggtgagaatgagcccctgccccattgtgaatggacacttctttgttcattgactaacgccactgctgtgtaacaccgtggtagggtccaattttagtatcatcttgcttcttgggaaaaaaaaacaaaaaaaaacaaaaaaacaccttaggtcagaaaaagacgagactattgaagaattccatgcatgttataaatgtgattaagtccacactgctgccaaggagtggaaacaaatcaggcacagaactcatggtaggacttcatcaggactggaatattctacacaacaaaggacttcatcttgactagggacagagcaggatggagctcagcacatggagaagactatttgaggcagagagtgtcagtaaactcatccattaatttttttcattcattcagcgccagattttgtacacgtactaagtgctgaataaatacagcagtgctgcaggcagtcccagggagccagtcactgactgtaaatacgctggggggtatttacatgtagagggggatgaccacctgaagacatggggagaagacagccagtgagagaggcctcagaagaaactaaccctgggccctaatccagtctggctagtgtccttataagaagaggagattagtcacagacacgtagaggaggatgaccacctgaagacacagggagaagatggccagcgagagaggcctcagaagaaactagcgtaactggaccttgccggttttgagtatcgtgagtaccctggcagcatagctggtatgagtactcgaagtaccccggcagagtagcggcacctagtagccacaagtaaggtgcaaatacccttgcagcgtatccaggcccagtaggcacgagtactataaataccctctgttatgggcttacttgtgttaccccaaattcatgtgttgaatctctaaccctagtgcctcagagcatgactatacttggaaatagagtctttaaagaggtgattaagttaaacgtggccgttagagtgggccctactccagtctgactggtgtccttataagaagaggagataagacttagacacatagagggggcaaccacctgaaagggagaagacggccagcgagagaggcctcagaagaaacgaaccctgctgaccttgatctcaggaagctaaacttgatctcagatgtccagcctccaggattgtttaagccccccagtctgtagtactttgttatggcagccctagcaagctaacatgccgctgtagagtgtgcagacccgcaggcatgggtcccgtgagcacccagcagggtgtctgggtgcagtagatgcgatggttggtgtataatatgaacactgtctctgcaggattcttgcctgtgaatgaaatggagggaattgaagatttcggtgtgcttgcagtctaggtcttgatctcaggtcatttcatagatgtttgagagttagagttctttcttgttatgattctagtcatgtatgtgttacccaacaatatttcattttatattaaaattacagatgcttgttagctcttttgttttgaatatttctgttcgctattcttatacagcagtcttccgttattcagttttgctttctgcagtttcagttacccacagtcagctgcagtctgaggatattaaatggaaaatttcagaaataagcaatttctaagttttaaattgtatgccattctgagtggcaggatgaaaccttgtgccgtctgctttcatccctttgtcccatgcacccacactgtagacgcccctacccatgagtcacttaataggagtctccgttatcaaatgactatcatggtatcacagttcttgtattcaaggaacccttattttaccagtagtggcctcaaagctcaagagtagtgatgctggcatattgttataattgttctattttattattagttatttattattacttaatctcttacagtgtctaatttatgaattaaacatcatcataggtcaccataggtatatatatacacttgacccttgaacaatataggggttacgggtgctaatccccacacagttgaaaatctacttttgattccccagaagttaactacaaatagcctgctgttgaccagaagccttaccagtaacataaacagttgataaacacatattttgtatgttatatgtattatatgctgtattcttcaaataagctggagaaaagaaaatgttattaaggaaatcataaggaagagaaaatgtatttactattctgttagtggaagcgggtcatcataacggtcttcatcctcgtcgtcttcacgttgagtaggctgaggaggaggaggaagaggaaagcattggtcttgctgtctcaggagtgacaagcagaaaaaaatccacatagaagtggatccacgcaattcaaaccagtgttgttcaactgtctaggaaaaaacacagtgtatatagggttcagtgctgtccacagttccaggaatcccctgcgggtcttggaatgtatctcctgtggttaatgggggggccactgtacagactgggcccttctttgggcgcccctttttctctgtttgaccaactcctttttattctttaaaacccagccaccagtgtcacctggaccaagaatcctttcctgtgtcatccagggcccctctcagtgcctctggaggaggctctgcctttttctttgctgttgcactctcatgagtgacagcatctgtccctcaccccacaaagtctctggcccagaaggttctcttcattattgctttttgagtgaacacttgaatgaatatatcactttcttgaaagccagtctttcaaaatggttgaattattttgttatttttaaattgtggtaaaatatatgtaacaaaatttgtgattttaaccattttaaatgtataaattcagtgacattaattacattcacaatattgtgcaaccatcaccactctctacttcaaaaattttcatgaccccaaactgaaactcagtactcaatgaagcagcacctccccatccctcccgcctcccagcccgtggtaacccacagtctgctttctgtctctgaatttgcctactctgtgtatctcaccttactctgtagtagtgacttagatgaaatataatatttgtctcatacaatactagtctttttgtgactggtttatttcacttagcataatgttttcaagttccatctgcttaccagaactatattcctttatggccaaataatattcgattatatggataggtcccattttgcttatccgttcatccatccatggacatttgggttgtttctaccttctggctattgtgaataatgctgttttgaacatagctttgaaatacctgttcaagcctctgttttcagttctattgcgtgtctacctaggagtagaattgccggatcatatggtgatcctacgtttaactttttgaggatctgccaaaactgttttccacaatggctgtaccattttacattcctaccagcagtgcaagagggttctaatttcttcgcattcttgccaatgcttgttattttcattttttttatgatagccattctagtatgtgtgaaggagtagctcattatggctttaatttgcgtttctgtaatgactagtgatgttgagtgtcttttcatgtgcttattggccatttgtatatcttcttagagaaacatctatttaaggtctttgcccattttgaaattgggttgtttatctttttgttattgaacaaaatggttgaaatttaaaagaaaaaagggtgctacttgaaaggtggacccttcctaatacctggctttccaggaagcttattctctgatggtgctagattgacaatgttattttaatcatcgtttcctcttccctcctgctttcttggctttttttgcactttttggagcattcatgttttgcctttttgttttttttgttttttgagacagagtctagctcttgtcacccaggctggagtgcagtggtgcaatctcggctcactgcaacctccacctcccgggttcaagcaattctcctgcctcagcctcccaagtagctgggattacaggcacccaccaccgcccccagctaagttttgtatttttagtagagacggggtttcaccacgttggccaggctggtctcgaactcctgacctcaggtgatccgcccgcctcagcctcctaaagtgctgggattacaggtatgagccactgcgcccattttggattaaacttcaaatagtactcaaagaatcagactgccgataatgtaggacaactgtccagaccgggccctttgtcagatgtcccttttctctctttgaccaactccttttgattctttaaaactcagccaccagtgtcacctggatcaagaatactgtcctgtgtcatctaagggccctctcagtgcctctctaaattccaaattttcactctggaaaattcaacaactcaaatgtattttcaagtgtattttaaaaattagagaactagattgtcaattcacgttatgtgaatgctctttaaaaagtggtaatgttttataaacgtactctgagcagtgttttccagtatattttggtgtgggatttggagcagggctttgaagtggaaaggcaaatgttttcttgggtagatctgaatattccgcaaaatgattccattgatcatccggtcgtagtctcactctctgaactataatgaaaagagagccaggggagagtgcagctgctccagggacccgggacaggtaccctggaaaggcatgggtagaggttccccccatcgttgggcccactggcatcactcctgttgctcccatcggcagctgtgggccagggcctctcatcctgtgtggaatctggcatcaggaattttcagtgggattttgaaagctattctaagagagtaaaatggtgggaggcatacacttctgtgctggctgctgaaatatgtggtatactggcctggaatacaactattttctctttttttaaatgaacgagttcattaagaaaaaaaatctgctgcaacctatagatccaaacacagttcaatacatcttttttttctttgtccaaactgaatattttcttatttttaatatcctgcctcattccatgaaggatttatgatatcttccagcagttgagtaggtttgctgaaatcattaacaaatatacaatttttttcttttcattttttactgaatgatgggattttttttttttttgctgcttcctccccttaacaaaaaagctttcttgaggtatcaacctataataatctgagcatatttaaatgaacaatttgataagttttgacatctgtatatgttcatgagaccataaccacaatcaagataatgaagatgttcattgcccctaaagtttcttttgtgcccctttgtcagccctccctgcccccctccactccaactactgacctgtcactattgattagtttgcattttgtgtaatcttatgtaactggaaccatgcagaatgtactctattttctggctgctttcacccagcacaattttgatattcatccgtgctgttgcttgtatcaatgttaatatgtttttatcgctgggcgccattgtatggacctaccacagtttatttatccatttacttgttgatggacatttgggctgtttcccaaatgtcccagtagtttttggctattacaaataaagctgcttttaacatttgtgtccatgtctttgtatggatggaggctttcatttctcttggggaaatacttgggcatggaatggccggactcaatagtgggtgtgtgtttagctgtctgccaaagtggttgtaccacctgacatccccacagccatgtcagagatgcaattgctgattcacatgctcaccaaaacttggtgtggtcggtctttttattttcagaccttctaacgggcgtgaggtgataactcatttcggttttaatttgcatttccctaatgactaatgatgttgagcaccttttgatatgcttatttgccatctgtatatcttccttggccaagtctctgttagatcttttgcttcgttttaaaattgggttattcactttcttgttgagctttgagaatgcttcatatattctggatacaagttctttatcagatatgtgatttgtaaatattttctcttgttctgtggcttatcttttcactctcctaacagtgtcttttgaaaagcagaagttcttaaatctaatttaccatttttttcttttttaaaaaataatttcaacttttattttagattcaaggggtacatgtgtcggttcttacatgggtgtatttcatgatgctgaggtttggggtatgattgattctgacacccaggtagtgagcatagtactcaataagttttgttttgtttttatggattggggttttgctgtcatatctacaagatctttgcctaaccaaggttataaagatttcctcctcagttttcttctacaagttttatagttttatttcttacttttaggtttatgatccattttgaattaatttttgcatatggtgcaatgtatggattgaggttcttttgtgtgtgtgggtatggatatgcaattgttccagcctaatttgttgaaaagactgtcttttctctactgaattgcctttgtacttttgttaaaaatcagttgcccataaaggtatcggtctgtttcttaactctctattctattctgttgatctgtttacaccattaccatgttgtcttgatgactgtcacttaagttgggcagtgtaagtctttcagctttgctctttttcaaagttgtggctagtctaggttcttcacatttccatgtgcattttgggatctgctattgagtttctacaaaaatcctgctgggatttttattgattgcattgaatctatacattaaatttttctgtagggaaaattgttagcttaacagtaatgaacagcaatgagtcttccaacccacagacacggtatatctctctgtttatttaggtcttctttgctttctctcagcagtgttttctgagagtaaaagcagtgttactttttggtgtgcagatgttgaacatcttttgccatatttatccctaagcatttcatatttttgataatgtaaatagtcccaattgtttggtgcaagtatatagaaatacaattgatttttatgtcttgatcttctatcctgaaaccttgataaacttacttattagttccagtaacttctttgtgtattccttcgattttctagttggacagccatgtcatttgtgaacaaaggcagttttacttattcctttctaatctagagagcttatatttctttttatttttcactgactaaaacctccaagataatattgaaatgtgtgatatttgttgtaggtgttctatagacacccttcatcagattgaggaagtccttttctcttcctagttcactgagtgtttatcagaaatggatgttggattttgtcaaatgctttttctgcatttattgacctgattacctcatttttcttttttagtctgtaaatacggattacattgatatttgaatgttaaaccattcctagaataaacctattaataggtcatgatgtattcttttttatataagactttcatttcctaaaattttaagaatgtttcctttttttttttgagacaaagtcttgctctatcacccaggctggagtgcagtggtgcagtctcggctcactgcaagctccgcctcccagttcaagcaattcttctgtctcagcctcctgagtagctgggactacaggtgcacgccaccatgcccaggtgatttctgtattttaagtagagatgggatttcaccatattggttaggctggtctcaaacacctgacctcaggttatgcacccgtggcctcccaaagtgctgggattacaagtgtgaggtactgtgcccggcctgcatttattttcatgagggatattggtctgtagttttcttttgtaatgtgtttgtctgattttgatattagagtaatgctggcctaatagatgagttgagaaatatttcttccttatcagttatctgaaatagtttgtgtgaattaacattattttttcctgaaatatttggtagaattcaccagtgaggttatcagtgatttgtggaaagattttgtttttgtttttgttttgttttgagaaagggtgtgactctgtcgcctaggctggagtgcagtggagtgatcttggctcactgcaacctctatctcccggcttcaagcaatcctcccacctcagcctccctagtagctgggactagaggtgtgcaccaccatacccagctaatttttgtattttttttgtagagatggggttttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttgttacttttttttctttcaagaatgtgtatattttatctaagttactgaatttattggcataaagtttttaaaaatatttctttatccttttgatatctatcgatctgtagtaatgtcaattctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcgtttttttctgcatactttgggttcctgaaggtttggttttcttaagtggatgctgagatcattccttccccatcccctacttccttctcctttcttcgtttctaatgtcgatgttgggtgacataaatttctttctaagcgacagctcacaaattttgatatgctgtgtttttatgttcattcagttagaaatactttctaattttcctttctgtctaatttgagttagtatttgtgaaagttttgtgtctagatgcattattttgcatgtggacattcaatatttccaacaccatttgctgaaaatactcttctttctctgtttaattgcctttgctcctttgtcaaagactagttgactgtatttgtgtgggtctatttctggactctctgttccattgatctatgtgtctgttctttcaccaattacatgacgtcttaattactatagctttataagtcttaaagtcaggtagtgtcagttctccagctttttactcttcttcagttttgtgttggctattctgggtcttttgcctttgcatataaactttaaattcactttgttgatatttacaaaatagcttgctggaattatgattgggaatgcattgaatctgtagatcaaattgagaagaattggcatcataacagtaatgagttttctaatccgtgaacatggaatatatctccgtttctttagaacttctttaatttcttttattatgttttagttttctgcatttaaatcctgtaaatattttggtagatgtatatgcacctatttcatttctggtactattataaatgccattgtgttttaaatttcaaattccaattgttcattgctggttcgtaggaaagtagttgacttttttgtgttaaccttgtatcatgtaacagtgttacgagagggtttttttggtcaattctttgggattttctacatagacatttatatcatctgcaaatagacagttttgtttcttccttcccagtctgtataccttttacttccttttcttgactttttgcactagctaggacttgcagtatgatgttgaatgtatatagtatagtcataataactatttaattgttcttgtctactaatcctattgtctgtgttatttctgggttagttttgcttggttgattcttttatttattttgggtcatatttttgtgcatctttgaatgtccagttgttttttcgtggaggtcagacgttgtgaattttgcctcgttgggtgctggatatttttgaattcctataaatatttcgagctttgtactgggggtagttacttggagacattttgatccttttgggtcttgctcttaagtttgttagggggaccagagtaggatttagtcttgggcaacatcctctgagtcctctccttccatgaggctgtggattatgaggttttccactctgcctgatggtgtcagggtatcaagaactattcccagctctaggtgagctctggtaattgttctaatttttttttttttttggatgatttttttttcagtcttgggtaatttcctcacatgtaaatgctgataagtactcaccagaagacttgagggcagggtgtgggagggtaatctttccagatctctgaagttttttctcttggcaatgctctcttccccattaccctctctgcgaaccccaatcgtcttggctgccctggacttacagccgtgtgtctcagcaacttagggagactcaggctttacctgggttccctccctgtctcacatcctggaaactctccagactatctgctgggctagtcctagggttcacctcttttgtttaccatctttcattgatcactcttcctcattgtctggtgtccaggtgtttgaaagctgatgtttaatatattttgtctgttcttttagctgtttaaggtaggaaggtaatctaatcactgttactccatcttggctggaagcagaagttgatggcactttttaaaaagtagctacagaatgtcaaaaaggattaaaaatttttttacagtaacaacgaatgtggatgggaggttagaactcaaactttcctttagattctaaccttaaaccgttgtagctccaccttttgataggaacctaaaagacaagttctaccataaaaacctaggtattttagtatcttccatagccgaacatatctattgttttgtcctgaaacagtaccaccagcctgttttagaaagttttttcttggaaaactaggtttctggctttggccccattggtgattttaaaccatttgaactgtgcttttctttttgttttgttgttttattgtttttgagagaggcttactctgtcccccaggctggagagcagtggtgcaatcacagctcactgcagcctcaaccttcccagctcaagcaatcctcctgcctcagcctaccaagtagctgggactacaggcatgaaccatcatgcctggctaattttttaaatcttttgtagagacggggtctcactatgttgccctggctggtcttgaactcctgggctcaaccactccccccacctcaaccttccaaagtgctgggattacaggcataagccaccatgcccggctacactgtgcttttctaaatttttatctcaattattaaaggacaggctcttatgcaggggaatattgtctgaaactaatcaaattattaagtcaggaagacaactaaatttttggatgatgtaaccatatagtactttaaatagaaaaaaattgtactaatagaagttagtagaaaaaatttagataataatagcttttattttattctttttgctgaaagactttgaaaccatggtgtaaaataaaaaatcattaaagctacctttttagatactttttgttaagtcagtttataaagtgaggatgtctatctggaatgtgtgacagatgtaacaagtgaaagttgcaatagtctccatgtaaaataaaatttggactgacagttttagatctttttcaagttttactctaatgctcattattttgtcttctcttcccttctccatctgcataattttaatctttcctttcatggttaagatttggcaacctcgtgtgccttgccaggatcattgttaaaaagctgtagtttttttttttctttctcccgtccaagctgtcccagagcctggtgagccacccttgcccttggtgtggtgtagctactgcgcctcatagcaaaaggccaggttttaaagcatagtgcttcacacgttatcaggaatttattttctgctcagctgcaggatctcttgtttgctttaaaactgtaaagtggagtgggggaaagctatcaacaatcttcaagtgcccaggtcttttagtttctgacagaaacaagagcatttctgcaaaggttggggagtgcgcgcgcgcgcgtgtgtgtgtgtgcgcgcgcgcgtgcatgtttgtagtatttagtaaacattccaaagatttcaaagtctccagggctccacaggatgtctttgttgacttcataactgtggttaggcaaaatgaaatgagagtccaggataggtcaagataaggtaattagcaaattcccttaaatactcaactagagaatttcaatggccagtctttttacagatgattgttcttatttttcctcttttgttttcaattacaattcattaattgaaacgtagtaacgggcctgaagttgtgttctgtactcacctgtgttttgatctttatctgtctagtcctcatattactttctggcaagcttgtgattctggcatataacagttggggcagggtgggggctattgatttgatccctcatctgtgttcctacatttctgttatggttatttgttggccagtctcttcttgctagactgagtgcccttggattgggaagatcgcattgcccggcactaggtctgccccagaaggatgctcaatatcattgtacagaattaaactgaaagtttgtttcctttaaactccatgtcatccaaggtaaacacagtcacatgttgcctcttagggtgatcttgagtattttttctcatctccatcaccaccattatccaacctaaggcttgtaaaagatctttataccatttctttccagattcaagaggctctgctgaagttcttttaatcaatattcgatgacaaatttttatatcaggcaaaggttgttgtagagctctttaagattcaattatgtgaacattagttcttgagcttcatttgaaacaggtttattttgaggtgggatcgattcttgtcattttctatgaagtgatgaacgtcagagccggagctcttgtggcaggtccagcttggaggtgagcaggacacagggttcctaactgacccagatgatccaaggagaactgggagtctgagaacagaaataaagctggagcccagccaggagtggtacgcagggctgcgaatctgacagcaaggccgaaatccaggcccgcaagtggcagagcaatgacagttaattgcttctctgtactgattgcttgtatgtttcttttgctattggatactaataggatgactccgaatatgacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacagctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggacactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattactaggccactttaacctccgggaatagcactcagataacaatgtcttagtattactggaagatttacagagtcaagagcctgctcttatccctggatactgagataatcacatgaatggagaaaaaagcatgcttctctcaccttttaatagagtgaaacacatcatgttaccggaaacccttttgttctgttttttacagtaagagaaaaagtaattaaacttcaaagtcagatctgtaaatagctacatgaggacctatggtaaaagcagagctacaaggtcttctttttgcttctgaaactgcgggtgatgtaggggctgcccagacccatggcatcccttgaaactcagaaagaagccagtgcttggctgggttctcatgagagtcaagttggagctggaggctatgagaggtaacacttggcctgtccttttgccactggtcgtgtgctgccaagtgggagggctcgtgtggcatcaaaccatgccttatcttaaggctaacatcacatttcctcaacttggccagaggtgctgcagagagagacctgcacagtatttgcagaatttgttcaataattattgttaatcgttgatttcactgaagatcaatgtttgctttttgctcttataaacaaaacaggaatattcataacaatggattctagtaaggctcaagtaccatttgtgttgagtgtctgtatgccgtcatagtattagaagtttcatacacgctaacattcatcttcacaggaacgtcagaaggcaggtggtattaggtcacatagctaataggggacagattaggaattggctactgctcagtttgaatcccaaatcagtgctctctctcttgtgcctctaaagccccaggacccagacagggcagtataggtaacccttagcagactactctcaacagtgtttggcccttgacaaaatgccacaaagttggaacgtgtagccctgagaagggttgttggcagaggctgcagagtggctttcagagtggttggccagctaagacatctgcatcaatgcctcgcaccactgggtgttcagttttccctctgattaaatcttgtctaccctgtgcccatagagtcagcatgtgctgcgagatcacaacgtgggagatcgttccccaatactgagatagagacaccgccccatagacgcagttacacactgccatgtgtaaacagatcaggaaaggagcaggtgcccagcccaaccggagctccagttcacacaaaagttttagaaaacccaagaggtaaaagtttagagaatattgtcttcttcaaacctccctctaacactgtaaagtgataatagacaagaatgtaaaaacttgggggaaaaaaagctaaagctcaattattgacactgttttaatgacctccacagatagatttgagaggtataggagcaaaaatgactttaaaataaataagttgttaaagttttattggtgctgcattcccaacctgaggttttctttgatgaaattcagatgaagtttcacatcttgtgctgtggaatcctatgaaatgcttagagattcaaatggtttgtgttggttaaagcaagctttaggctttgttcttcattatgctaatcagtttttcccccagcttaattgaagtgtaaagtcatttgaacaacactggtcttttctgtacacaagaaggttaagaacctcagacagctcatgctgctgccaagaagtctcccagtcgtattcttcagattaattacctgcagaaacagaagtaagaaaatccattacaggttaaagcaatgattttggcaggatctgaaaagcactaggattatgtcatggggaaaacttcagcaaatctcacaaatgggggctctcctaagcagatctgacatttcagtttttaaccatttgtatttgaaggcaaatattgaggtggtgggggtttttattaaaatattaaaatcaaactttttcctatataaattcagcaatataatttaaatattctgatttgtgcagttttattaaagccactgagaccacagtgatgctaaagtttttgaatgcagggagcaggccagtcttgccttactctgtatgttgttttataatattgatttgaaaatgcaaggttatactacagagaccaactttttcctcctcaatcctgtgctggcagccacaataaatgtgcttgagtcccagcagtgagcgtgtgtgccttctctagaagctgctgtctgcacgaacaacccaaaaatgtcatagaaatgcacagttctaggctgggtgtggtggctcatgcctgtgtaatcccagcactttgagacgctgaggcaggataatcgcttgaggctaggagttcaagaccagcctgtgcaacataatgagaccccatctctataaaaagtttaaaaattacctagatgtggtggtgtgcatctgtacttccaactactcgggaggctgagataggaggattgtttgagcccaggtcaaggctccagtgagctgtaatcgcaccactgcactccagcctgggcaacagagtgagacactattgctaaagaaaaaaaataaatgcatgagtctatgctacagattctttcatgatttaaaaagcaaatattattaattatgcactaatttctaattattcagtgctaatttgcataaccgttgagacagcacataggaattttgttaaacttggatttgttttggtaatttttattggaaacaacaatagtaacaataacttaattacagcttatatttatttatacatgcactatatgcaaaaagtattctaagtactctaaatgtgtcaactcatttaatattataacaaccctatgaaatactcttgttgcacctgttttatacatagaggcagatagagattaagtagtttgtcctaggtcatgtagctagtaagtggcagagctgggatttgaacccaggtagcttgactccatagtccgtgctcttaaagactgaagtctatgcctcttctgccagtgctgtcaacactgacttagctctagaatgtcttctcctaccttagtagaactctccctgccttccgcctgaggccagagaccttcccaggtaggtgtgtgttgacccagcgtcctacacaatggttgttacaccaacctgactctgccttcttttattcacacattagaagatttcactgaactgtttaattactcctcagagggaagacagatataaaataccttcttatcttccccacttctctctcccagtggcatgacattttgaagtgagattttctttccctcctatccaaagtcaaaggagaaatggagaaattccacagaactactgtccattcacaagaagttacatagcacttaaggacagtctctttcccttgagcaataagtacttagttttcattgaaatatttctctgctgagctctcatagtataatagcaaccaatcccaacaagcaaaaataacttgtaaatttgcaaaaccaggccaggcgcagtggctcacacctgtaatcccagcactttgggaggccgaggcgggcggatcacaaggtcaggggttcaagaccaacctggcccacatagcgaaaccccgtctctactgaaaatacaaaaattagccgagcatggtggtgtgtgcctgtagtcccagctactggggaggctgaggcaagagaatcacctgaatctgggaggtggaggttgcagtgagctgagatcataccaccgcactccagcttgggcaacagagtgagactttgtcaaaaaaaaaaaaaaaaaattggcaaaaccaatgagtggaccttatcttacttaaatgctcataaaattactttattttatatgttaacattcaataaaaactgtcatttttgagataattctatgtgttttaacaaagtatggtttaatgtaacaaccaccactaaggatatagaacattccaattaccttcaaaattcccttgtgcagtgtccccaacccagcatttggcaaccactgatccattctccttcattacagttttgtctttggagaatgtcatataaatggaatagtacaggatgtaaccttttgagatgggctttcttcattcagtataatgcctttgagacccatgcaagttgttttgtgtatcagtcattcatcccattttattactgagtatattccattgtatgagtgcaccacagtttatccattcaccagttgaagggcctttgagttgtttccagtttctatcaagtctgaacagagccaccagaaacattggcgtatcggtttttgtatgaatattgttcatttttctagagcaaatacttaagaattgctaggtcatattggaaatatgtgtttataagaaaatggtaaactgttttccagggtggtcgtgtcattttgtgtgcccaccagcagtgggggagagtgtgtttcatttgctccatattctcactgcacttgcttttgtcagcatttttacttttaaccatcctaatagatgtgtaataatatctcattgtagttttaatttgcatttccataatgactaatgatgttgaacatcttttcctgtgcctgcttgttacctgaataacctctttggtggtctatttaagtcttttgcccatttttccccttgcctatttttaaaattggattgttttctcactgttgagtttgtaaagttctttatatttctcattcaatagagagaaacagaaaaaagaggacgtgcacacatccccatcagtactcctaataaacagtatggattctacattgggagcataaagaatggtatatttagttctaggagaggaggagcatgagaaaaggatatttgcaagttgttcttgctttatagttttacttctttaaagagatatgcttaagacatagttttaaaaagacttacacaatattttttttgtaagagcttagcggctctcttggttaatagatatgttattctctctcagaagtgccatagacacacttgaaaattatttctatgtgtgaaacaattatctgttacttagaaaattgacagagcctggctgggcgctgaggctcacgcctgtaatcccagcactttgggaagccgaggtggttggatcacctgaggtcaggagttcaagaccagcctggccaatgtggtgaaaccccatcctactaaaaatacaaaaattagccggcgttggtggcaggtgcctgtaatcccagctactcaggaggctgaggcaggagaattgcttgaacccaggaggcggcggttgcagtgagctgagatcacgccactgcactccagcctgggcaatagagcaagactctgtctcaaaaaaaaaaaaaaaagaaaagaaaaagaaaaaagaaaattgacagagcctgaatttaagggcaagacagaattatttatccaggaagcagaagttacaaggtggcagatttcaatgtcagaggccacttattattatctaaatattccatatgttttcatgtttctgcgtttttgtttaaattgcttgtttcctttgcttggaatgccattcttatttttccagctggtgatttttttttttttttttttgagacagagtcttgctctgtcacccaggctggagtgcagtggcgcaatctcggcttactgcaaccttcacctcccaggttcaagcgattctcctgcctcagcctcccgagtagctgggactacaggtgtgtaccaccatgcccagctaatttttgtatttttagtagagatggggttttgccatgttggccagactggtctcaaactcctgacctcaggtgatccacccaccttggcatcccaaagtgctgagattacaggcatgagccaccacccccagccctggtgaatatttttattcttcaaggccaacccctgcttgatcccatttttccaaatacagctaatattttctttgttcacttatcactttatatgtttatataacttatcaaattattttagaaatttgtaggcaggtgtcttctccactaggcagagagcttcttaaggatagctgtgtgagtgaatcatcttttatccctaacaactaatttaatgcatgcttcaaaagagatactcatttacccatttattcattaatttaccaaatatttattgagttctcactgtatgttaggttgaggggcagagtagtgaaccaacagaaaagattcctgctttatggagcttacattttgttgaccttttcagataaccagattctccttttctaaaacagtggttttaaagctattagttttcctcaaagccctgctttagctgcatcccatgtattttgctatgttgtattttcattatcatttgattattctaatttctcctgatatcttctttgatccaatgattatttagaaatgtattgcttcatttccaaatatttgtagttgatttctaacaatatcattgtggtcagagaacatactcttcccatctttaaatttatttcaatctgtttaatgacccagaatatgatgtgtcctgaaaatgtaccgtatgcactgctattgttagctaccgttttctctacgtatcagttaagtcaacacggtttatagtgttgttcaaatattctatgtctgtactggttttttgtttgtttgttttaagatagaatttcattctgttttcgaggctggagtgcagtggcgtgatcatagttcactgtagacctgatctcctgggctccatgattctcccacctaagcctcccaagtagctaggactacaggcatatgccaccatgcctggctaatttttaaattttttatagagatgagatcttgctataccacccaagcttttatttatttttttattagttgttctatcagttgctgagagagggacattaaaatcttcaggaaaaattatagaattgtctgtttctaactttaattctgtcagttttgcttcatgtattttaaagctctattaggcacatatgattgcagtgtttttctgataattgacccttttttcattatgaaatggccctttttatttctggtaatacattttgacatctattttatctgatattaatattgccatccagcctttttatacttattatttccatggtatatattttttccattcatatactttcaatctatctgtgtctttgtatttaaagtgtatctcttgtagacagcatatagttgggttttgcttttttaaaaaaaaaattattctgccatcctctgccttttaattggtgtgtttaatgaaattattgctttaatgtaacatgtaatagaattattgctatattgggtttgagtttagcattttattttttgttttttacttgtcttttttgtacctctgttactcttttctttccttcttttgaattatttgaatatagaatttcattttaaattttctgttggctttttagctacactcctttgcattattctttagtcatttatgagggatcacaatatacatctgtgacttttccactacagttaatactaaccccttacagttaataataactgcttacatgagatctattgtacaacattgtgactaacatatgtataattaataacatgtatgtatccttgagaaccactaagagagtagattttaagtgttcttaccacaaaaataagtatgtgaggtaatgcatgtgtgtgttagctcaatttagccattccacaatgtatatatatatattttaaaacatgttgtatacaatatatacaatttttgccaattaaaataaatgaaagccacttataattaatgacatatacttcatataaaatactgaaatcttgcaacttgtagatccatatttaccccatcttttatgttatggtacttgtatttattacataaaaatacattataaatcctgtaagacaatattttaatttctgtctttaaaagtttgaaggttcaaggctgggcacagtggctaacacctgtaatcccagcactttgggagggtgaagcaggatcacttgaggccatggattcaagaccagcctgggcaacacagtgagaccctgcctctataaaaaatttaaaaattagccaagcgtggtggggtgcgcctgtagtcccagatcctcagaaggctgaggtgggaggatcacttgagcctagggagtgaaggctgcagtgagctgtgatcacaccactgtactgcagcctgggcaacggagtaagaccctgtcaaaaaaaaaaaaaataataaaacttaaggtttcataataacataaaaggaaaaaggaaaaaaatgagtctttgaactgatgcaggtatttatcatttccagtgctcttcatttttttctgagggtctgagtttgatcttatataatttttctttagcctgaagaactttcattagcatttcttgcagtgcaggtcttttgatgattaattctttctggttttgttactctgaaaatgtctttattttgcttgctttcttggaagatattttgctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtatatatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccagagtgatgggattacagacatgagccacggcacctggcctgtaattgtgtatttgtgttcattaaatttgtgctatttcagccatttatttgtttgttttgtttttgcgccactgcgctccagcctgggcgaccctgtcacccggggtcttgctctgtcacccaggctggagtgcagtggtgcaatctcagctcactgcagccttgacctctcgggccccaagaaactgccccacctcagcctcctgagtagctggtactacaggcacataccaccacacctggctaatttttttttttttttggtattttgtagaggcagagttttgtcatgttgcctaggctgatatcaaactcctgcgctcaagcagtctgcctacctcagcctcccaaagtgttctctgtgttctctggttggagcacagtaagtgaagggaagaatgatgtacaatgagattggagaggcgaagaagatcacggagaggtttatagaccctgataaggagttggaaattatgattctgagtaagaaaatatgattaccataattgtaagggtagcttgccaaactcatattgctttatccttcagagtcttgaccgatggatagggtggccttgtgattgtatgacctacctgtcagttaacataattggaacagaagctagaagaccatgcagactgggtttctgcagtgtgtgggaagttgaagtggacgtattctaacatcccttccactgctaaggttctccggtatcgctgaaaacaagttggcctccatgtagaaaagtataatgtcaattaaaaccacagtttataatgaagagtgcaaatgtagagaatgaaaagaccattgtagaatgaagagttgtagttacacacagctaaagatttcatgtgatttctgcttaagagcagtatctgtagtccgtaagtgttactatgttaaaacaatgggcttaaaacagcatgctagatagagtatgtttatagatctgatttccggggaacacttaaagctcacttgatcctttctttggtttagatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaaggtgggcgtttgagtgacacaggaacttcagtagaattggtctcgtggcagaatcttgctctagcaaacacattgtgctctttaatattgacagagaatcgaaacttagaataacaataaaacagtcttagcactgtcaacataatcacacgacgtatgatagtattttggggcttgatgttggtgaattgtacagcccagtgatgtacatttgtaggtgatcattaaatgcttgttgagtcaaggaaggaacaatccaaatggaccactgagaacagttcttttttttttgagacagagtctcgctctgtcgcccaggctagagtgcagtggcgcgatctgggctcactgccagctctgcctcctgggttcacgccattctcctgcctcagccccacgagtagctgggactacaggcgcccgccaccacgcccggcttattttttgtatttttagtggagacagagtttcaccgtgttagccaggatggtctcgatctcctgacctcgtgatccgcccgcctcggcctcccaaagtgctgggattacaggcgtgagccactgcgcccggccgagaacagttctttatcaggattctctgggatggagagagcttgcagaaagaaccatgatcctttgggccacttttggaggttgttctacctagcttttttttgaaaactgttatctctttatatgcacttagcttatactgtcattcagttcagcatagcaacactcgatcatatgccacattcaaagctctgagccaagcactgggggtgcagaggtggcgggcctccctctgaggagctcagagtcctatgttatcattagctcttcccctcttctagctgcaaagcaagccactctcatgcaaagcccagtgttccttttgaatctcctctgctgtccacaaggacatcacctgctacagagctctgtccctggtagatttctagcaaatttaagtcatcatttcatgtccctgtggctcttgggaatgagatattaaaaagcaatatttgtattaaataatgttgtcattatcttcttagaagataatggaattagacaattagacaatgttggaaataaaacgcctcctaacaatttctgtccagctagctggcgccctcatgtctacatgaacttgcaaatggctcgtctttagccagaatcactcttcctcgtgactaactgtagaaaagagaattcgtcttggctgtaagatgcctttggctaaaacgttttttgagattacaacatttagatgttcctttaaaaatacctttcattggctgggcacagtggcacacgcctgtaatcccagcactttggaaggctgaggcggtcagatcacctgagcccaggagttcaagacccatctaggcaacatagtgagacctcatccctacaaaaaatttaaaaattagctggatgtggtagcaagtgcccgtggtcccagctactcaggaggctgaggtaggaggattgcttgagcctaggaggccaaggctgcagagagcaccactgcactccagccgggtgacagagcaagaccccatctcaaaacaaaaacaaacaaaaggaatacctttcattgttatttcaatttaacaaattatttcacagttaatgtgtattttccttagagttgggagggaggactgtctaaggttgcgtctttgagtttttttttctcaagtacttggctgcatttccacacatctgtgggaagaaatcaatttctttgtcatcccagatgttatcaccagcttcgtgtgagatggctggctacacctgttgggctgatgtctgcattttgaataatcattttaagtaatcttttttcctcctgagttacaaagtgattcaggtattttaaatagaaaccgcattattttaagtattcttgacctaccagctttccaaaaataaatctgatgactgctgtgtctgaaagggtacatttgaaggagctgttttatataaatcttcagacctctaaaacttccttatttttagaaaactacaggaagaaaataacagggtgtgcccaagagttttgttttcttgattaagaatgatttgaatttcataactgcacagaaaaataaatgttttcatagtcatctgatatttctttataaacattctttttctaactgtaagcaaatcaaagcttagttgccagaaggtcacaccaagaagtaaaaaaaagattcacaagaaagcaggtgaatgggctgcatcccctgagtggagggaccttgggctctctactttctgtgcagctaattagagcacagtggaaacaggggcaggaggggcgtgcccgtgggaggggcatgcccacgggaggggtgtgcccgtgggaggggtgtgcctgcagcagctgccctggctgtgctcatctttgaggcagctgccacgtgggcacttgggaactggtgcccacacctctgtctgtctttagagctggctctctgtggtcatggttggggtggggagtcttttaggcaagatggattttaggcaaatctcctttggttttaagtggccacacaattatcacttcataatattttggcctgccatgctcatatagacttgaagtagcctggacacatgacattcttatttttatttctgagacagattcttgctgtgtcacccaagctggagtgcagtggcgtgatcttggttctctgcaacctccgcctcccgggttcaagcgattctccagcctcagcttcccgagttgctgggactacaggcacacgccaccacacctgctaatttttttgtatttttagtagagacggggtttcaccatgttggccaggccggttttgaactcctgaccttaggtgatccgcctgcctcggcctcccaaagtgctgggattacaggcatgagccaccgcatctgacctgcattcttatttttaaatatcaaatgattttttcccccacagttagttttttaatgcttaggtctcactcagtatgttgaggtttgggtgtacagcttttgctgtctgcccaatgctgggcgtggctgtgccaccaagaagcaggcaggtactcactgggggtcctgctcaaagccagtgcgggaagagcgcgtgtctttctgctgccgtagccgctagctagtttttagactgcagtcaacactcactggcctcagcagtacctgtggagccatagataatcattctgattcctttccacaataatactccacttatttgaagaatgttatcatgacctctaagctttggctgactatcattcttcatatgccttgactagtataacgatgagaactgcaggttcatggaaataattcactgacagctaaggtcaaggcttcctgaaatgggatgagattgtggcccactgtaatgtgctgggcctgtggataggtattctgtagagagggagctgtcacttgttcccctgtccctgcggttggcctgcttgcaccagttacccaggtcttctttcccttgaggatactgctctgggtcttaggatttcctcagtctctgtgagctccccagactctgctttctccttttcctttgatattttttaaaataggaagaaccggctaccatatcacacaccttcactgtggtgaacctcagcccataaagctggcttggttcatgttggatttactcttggatagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcgcaacggagaaaaactggataggaaacaataagggagcagcaagcagtaggggcatggccaggagatgatggtgcctccatatgattaaatgctgtgtggtctttaaaaatgtttgtgttactggtacaagagggaaaatgcttacgcattacattgagtcaaatgcaggctataaaactgtatatactgtatcatttcaactaaatagacaaaatttatgcaaagaagactggaatgaagtactgtatagcaaaagtaattcacgggttttttcctgagtaataggattatgaatttttaaatacttttagttagtttctaaatgttctgtggtgtgtatttcttaataagcagaagaaatttgtgttctaaaaaatcacttctttctttgcattgaatctgaggtcaacagcagggctcatggcaaatgtcaggaggccaggggtttactcacatgtgttttcaagaagacagggagtagtttggagttcaatcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttcccttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacagatttttagctgtgagaagcctgtgctacactggcacttaacactgatattcagaatactactcataggtaccatgtattgattgactaagggctggactttgcagcagacattttggatgtattcactcatttcacccctccacgtttctgtgaggcaactatcattgtgcccattttatagatgagaatgaaacctctgggaggtttagtgatttgcccaggctacacaagggctaaatctgggactggaccccagggcccggctggcatgttctttctgccatctgcattgcctcactgtgcatgcctctagcagtattccataagttagcattattcacattaaaccaaatatttaaaacatgaatataatttgaaaatcttttttcaaggtttaatttgatttgcaaagtgtgccaaatacactagatcatattcagcacatcattgtgtgaaatactatgttacggtctcttcacaagttttattaggtaggtgcaactgacaaattaaaatttttaagctcttggcagtcaatgacattaatgaataattaacttagttctttatcctggttaaccaaaattaaggagcaagtggcttttgctttttctcttgtctactgcaccttctccttacaaattggcaaattacagaaaaaaatcttttctcttttgctcttttagatagaacatactatagtttcttttgtttctctcattagctgccctctccagtttagatagatattctgtagtgatttatagaaaagggtttagtagatgtttgtagtttttcagagattaaaaaagacgtttcaaattttgtattatgaaaatgttctcaaatgtgtacaaaagtagaaagaagagtaccttttacctgccattctcatttatcaatatgtggtcagttttcattatgaccctctcccactacccctcaccccatattggattattttaaagcaaatctaagacgctatatcattttatctgtaaatatgtcagtatgtatttctaagatatagactcttttttaaagtccataatggctgggcatggtggctcatgcctgtaatcccagcactttgggaggctgaggcaggtggatcacttgagcccacgagttagagactggcctgggcaacatggtgaaaccccacctctacaaaaaataccgaaattagccttgtgtgatggcgtgaacctgtagccccagctatgctggtggccaaggcaggaggatcacttgagcccaggaggtcgaggctgcagtgagccgaggtcacacactgcacttcagcctgggcaacagggcaagactctgtctcaaaaaaaaaataaataaataaagcaaaaataaaaataaagtctataataccattattacacttaaaaattaataatttcttaatatcatttaatagcaagtcagcattcagatttccctaattgtccaatgaatgactttttaatagcagttttattgaaatataattcacataccataaaactgacccttttaaaatgtacgattcattgattattagtataagttgtaaaaccatcaccactatctaattttagaaaatttgtatcacccggaaagaaactcctcacccatgagcggtcatttccagttgctccctcctcccagtccctggcaactgctagtctacatcatgtctccatagatttgccaccttggatgttttctggaaatgaattcatacaatatgtggtcttttgccactgtcttctcccacttagcatacttgttttcagggttcacccatgttggatcacacatcattccttttcattgtcaagtaatattccactggatgcaacattttgtttatccatttatcaggcaatgggcatttcagttgttaataaattactttatgaaatcagttcattaatgtctttttccccatttatatttctattatattgaatttttaatgttacaggattcttgcactcctagacccatgcctaagaattcaaatgaaaacgcatggtacaatggacagccccatctacatgtaccttttgataatttcgaaacctttttaaagtgatgcagtaagagacagtgttttaactctgctgcagggtttcaggtttctggacagtagatacaaagtagcatgctctcttgttctgaaccttgctctttttacttagcagtgtggcctacaaggcattcctttgcagtgtctagagctcctcctcattccttttttttttttttttaggcagagtttttgctcttgttgcccaggctggagtacaatggtgcgatctcagctcaccacaacctctgcctcccagattcaagcgattctcctgcctcagcctcccgagtagctgggattacaggcatgcacctccacgcccagctaatttttgtatttttagtagagacgggttttctccatgttggtcaggctggtcgtgaactcccagcctcaggtgattcacccacctcggcctcccaaagtgctaggattacaggcgtgagccaccgcacccagcctcctcattccttttacagctgcacagtgctcccttgctaggagatgccacagtgtattcaaccagtccctgcaacaggctttggttttgcaaattgtgctgcagtgattggccgtatgcgtagggcattttgtatttttgccagtctctttaggacaggtgcctagaagtaggggtgctgggtcagaggatacgtgcacctgtgattttgctggatgatggtgatggtgatgataggaatctcctccagcactcagctaatcatctactttgtcttataacttagcaaaagcaggttgccttttccagttctaaatacagacatcttttaaattttgaaatggataattaggaattctagcttcatagtggttagatatgttaaaagtaaactttggatttcctcatataatcatatatgtaatcatgtttttaagcctaatgggagttttatatatcaaatagtgcacattgcattattgatgtgatgtaagttaaaagcatttcttgatcattagattataacttaatatcaaaaaaatgcattagtagatttggctagctttactagaacttctagatttattcatatcaactgtagttttgaaaatatattatcatggatagtgctttttgaagtctggttattctaattcaaccatttagaatgatgaaaaaaatttatttcaggcttaattatgaatgtgtttggacctgagatttttaataccttagttagattttcagttaccaaactatggagtcatattgcagggaatctaactcaaggtggtttaaatagtatgaaatataacaggaaactgctgagcataaataccgcacctgttactggaaaccagtcttcagcttggttgcccttctcccttcacttccagcgggttggtagggtctgttctcagagaggccaactcattgggaaactcaaatgttgctttacagaacacgcttctcacatgaatgaaagacaacagatttcagagtgggaagataccttaaggaacatttttgagcaaaggctttcctttatgggtaaggaaaattggacccagaggaccttgcctgtggacacctggctaggtggggacacagcagggactggcgccccggcccctgaatcccaggcctgagttccttcccctcctctccactacctcccccactctgccttggtgtaagcacaggaagtaagtggctggttttgggggagaatgtgcctagggttctactccaaatctgtgtacaggatatgcagcccatgggttctcactggctctgattctgcctctggtaccacttgaccatagcattttattctcttcacattatattcacgatacaaaattgcacccattgtccacaacagagcattttattgtcgggatgtagccaggggataatggctaccacttctagggtgtctactatgtgccgggcactgtactagaaacttcgcattgctcattcctagtcctcacagcagccctgcaaggtgggtgggcactctgaccttattttagaaagaatccaaggcgtgtgctgtgtcttccagctcagctgaggatgagtccagtcctgtctgccttgaggacccttgccctccttcacctgggcacctcttacccccagagacaggattccagccatcctgcaatccttccaccggatgcgttccaaacacagcgtttctcaggctcctttcatctgagaaattctccttttggtgctgtgtttgttgtcgtgttttgcctctaggaaaaagttaattttttttttaaaacaaccctttcatgaaccaaaagaatctctcatatcttagtgtcatctggaagctagggatccatttaccttagcacatgacgagcagaaaattgtgtttgaaacttccctgctgctatgtcacttctgcatttttaaagagcacttatctgaaaatgattcattacagctgctcctctttcctgtcatcttcaagatccaggctggcacctgttcagactcaacactaggaggtatttttccttccaccaggttttcttaccgcagcgagctttcttccttgagtggctaataatttttatacatggtaatgtgaaagaaacctggcgtgatggcatgtgcaaaataggtacttagtaagcgtgctggtggtgggggttacgatgctatttaatcagtcagtggttacaaaaacccaaggatgttatcaagacagggatgagcagcaattggatcttgccgaagttgggatctatccaacttctcagtcattccaagagtagtcagtgtgtgtccccctcccccttcccatccctctcctcttcctcctcttcccaccctctatttttctttcatgatctctcatcacaactttaatattctacttgcttctgatgctactctatgatattttaagatataaaatatacactctgggaatgcctcctgcattgcatctgattttcttttcatgggcttttaaaatcctattttctatttcttcttttgagaaaaggacaacaatagattattatgagattgaattttgaaattatcactcaagaaagaatgaacaacttagtagtaactccaaaatggcaacataatgtctgctcttagaagcaaggctttcgttactgaaattaaaccaagttacatttccagtgtatgttcactcccttctgtgtgtaggcctgggagcaggtactagcttcaaggatcctgcagtcagtggagtagacagactattggatttagcgttccaagtgtgatgacggtggccagggcaaggcgctgtgggagcatggaggaggccccactttcttttacattaaagagagaaggaagattggccctcagctttagggactggaaagttccagcaagttaaaaatttggcataatacacagttttgttgttggtaatattttaagagcctaaatggaggcagatttaattctatgatgaacaaaatctgctagcttttttgtttgattggagatggagtatcactctgttgcccaggctggagtgcagtgacaggatctcagctcactgcaacctctgcctcccgggttcaagcaattctcctgcctcagcatccttagtagctgggatgacaggcgcatgtcaccacgcctggctaatttttctgtttttagtagagacgaggtttcaccatgttggccaggctggtctcaaactcctgtcctcaggttatccacctgcctcagcctcccaaagtgctgagattacaggagtgagccaccatgcctggcctctgctagcatttttaaatgaactttttattttaggatagttttagatttctagaaaagttgtaagcacagaaggttcccatagacccagtacccagtttcccctgttattaccgtcttacattagtatggtacatttgtcacaactaatggatcaatattaatacattattattaattaatgaccatgctctattgggatttccttagtttgtcccttaagcccttttggttccaggttcccatgcaggataacacattatctttagttaccctggctcctcagcctcctccaggctgacagtcttccttgtttttgatgatcttgacagttttgaggaatacctgttagagggttcattgactatccttcaccttggcttcgcctgatgtttttctcatggatagactcagcttatgggctttagggaggaaggcacagaggtaaagtgccattctcatcttatcagcacatcccgtccaagggtgcatgctatcaacatggctcatcactgtggttgttgaccttggccatctggctgagggggtgttggtcaggtctctccactggaaagtaacttctcccccaacttcgtcatgtggctgttagaaggaagtcagtatgtgccagctacatttaaggagtggcagattatattttaccttcttgagggtggggtagccacataaattattcagaatacagctgtatggggatttgtccgttctcttcatttatgtatttacccaatcatttatttatatatactgtagcataaacttacagatactcgttgtgtactttgggttataatcgaatactatgttatttgttttgtggctcaaattgttccagctttggcctttgggagctctttcagttaggttttgtgtccgtttgacttgcccccaccaaaatagtgtcttttggttttgttgttgttgtctgagcacttctttactttctggcaccacagaagactccagattcatgtgctccctgccccagccgtacgtgctgctgcttcccctgaaggcatgctttcttctgctgtagaatggccttggaaaccaaggtttgggcattaggtgtcattgctttaggccctgtcagcagacagagctcagaaacatgtgtttatactaacctgtgtgtgtgggtgtctatgtatgtatttatacttacatgtctgcatctgtgttaagggaaacctgagtccacactgatgtctctactctagtggcacatggttcattcccgccatctgcccttgcttatccatcacctccctctccaacagtgagagacctgccgctgccatcctccatccttttatgtaattgttccatcctgatgttcctgtgtagtggtttcagaattgttagcctccacctttgtgggaagcacccttactaactagaatacagtgctgatgcgcagttcctgttatctttagttttacagtctctactcatttccaaaatgacttaggtcagcatcttcctgccccccactaccttcagtgaggttgtcatatgtttgtcatacaatcttcattccatcatggggtttccctgtctcctagatggttttacttgcatacttcaaggttcactcttggtgctgtaagggtctctgggctttgacaaggcatcatgtcacatatgccccatgatggtatcttacagaatagttttatcaccctagaagacttcctgtatgtcacctattcagcccctgccctgcaacctctgacagccacaaatcgattttctgtctttagtttacctttactcaaatgtcatataaatgcaatcatacaacatggagcctctcagacttgctgctttcccttagcaatgtggatttcagatgtggtttgcttcattccttttatcaccaactcatattccattgtatggatgggtcagtttgtttatctgttcacctatcagaggacatcttggtcgcttcccgtttttgacgattgtaaataaagcagctctaaatatttacatgcgggtttgtgtagacataagttttcagatcaattgggtaaatacctagtgtcagtacaattactggatcatatggtgaaactatatttagctttataagaaactgccagactgtcttccacagtggctgtactatttttcattcccaccagcaaggaatgagagttcctgttgatcggcatcccggccatcaattggtattttgtctgtctttttggatttcagccattctaataggtgtatagaagtatcgcattattgttttaatttgcatttccctaatgacaaatgacgttgagcatcttttcatatgcttatttgccatctgtatatgtcttctttggtgaagtgtcttttcagatcttttgcccatttttttaattgggctgtttgttttcttaccattgaatttgaagagttccttttatgttccttatacaagtcttttatcagatacgtgatgtgcaaatattttctcccaatctatgccttgtattttaatcctcttaagttcttttgcaaatttttaaaaatgttaatgaagtccaaactatcaatttttttctttcatggattgtgcttttggtattatatctaaaaactcatcaccaaaccactttcttctagaagttttatagttttgcattttaaatttaggtttatgggctgttttaatttttgtgtagggtgtgaggttagtgtctaggttgcctttgttgaaaagatgatcttggctgggcatggtggctctcacctgtaatcccaacactgggaggccgaggcaggcggatcacctgaggtcaggagttcgagaccagcctggccaacatggcgaaaccccatctctactaaatatacaaaaattagctgggcatggtagccagcacctgtaatcccagctactcaggaggctgaggtaggagaatcgcttgaacccaggagaccgagttggctgagattgtgccactgcactccagcctgagcaacaagagtgaaactctgtctcaaaaaaaaaaaaaaaaaaagaaaagatgatcctttctccaaggaattgccttcatacctttgtcagtgctgctggtgtttcaaaattcatgtccttttcctttctacttagcttatgttctgtaaaacagtggtctccagcctttttggcaccaaggaaattgtggaagatgatttttccacagaagtggggcgggtggtggggatggttttggggctattcaagcatggtacatttattgtgtaccttctttcttattatttattgtgtaccttctttcttactattacattttaatatataatgaaataattatacagctcaccataacgtagaatcagtggcagtcctgagcttgttttcctgcaaccagatagtcccatctagggttgatgggagacagcgacagatcatcaggcattagattctcataaggaatgctcaacctagatccctcgcatgcacagttcacaagagtttgcactcctatgagaatctaatctgatctgacaggaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgcctttaagaaccacggtcaacaatggcactgtgttaccaaagaaacctactggctctctaccatccccctccggggtcaggaaagaaactgctgtgccagcaaccaaaaggtgagccagaagcagggccttaaatgaactctcaaagcagttctctcttagattccaacatgagtattactttttaaaatgacattgtacaatttcttctgtgagttaaagcttataaaagtccaacattttatatggtgccataacaagaactagttaagtttattattattcttgttttagatttacttgtgttgcctttgaaacctcactggctaaaaccacagtgtggtgttttgtatttttacttaaagttctcttttgaaaaaacaaatgttagtataacctgggtaaaaataaatagctgttcccaagtccatactgggaacatggcaaaattcagattgccatagcaaccttagatttttctctatgcaatttggataagctcatactttcaaaatgtacccaacaatggagtctaaatattgatgttatctgtcacaaagagcacagtttgctcttaactttgctattattttgtaattatcatttaaagatttttatattttagggccaggtgcagtggcttacacctataatcccagcactttgggaggccaaggtgggcggatcacttgagctcaggagtgtgagaccagcccaccttaaccatttttaagtgtagagttcagtagtgctggccgggcttggtggctcatgcctgtaattccagcactttgggaggccaaggcgggcagatcatctgtggtcaggagttcgagaccagcctgaccaacaggcgaagccctatctctactaaaaatacaaaaattatctgagcgtggtggcacatgcctgtgatcccagctacttgggaggctgaggcaggagaatcgcttgaacctggaaggccaaggttgcagtgagtcaagattgcaccattgcaccccagcctgggtgacaagagcaaaactccatctcaaaaaaaaaaaaaaaaaaaaaaaaaagagttcagtagtgttaagtatattcacgcatctattgttgtgcaacagatctctagaactttttcatcaggcaaaatagaaactctagacccattaaatagtaactcccctctactctccccactgcccttggcaaccacctctctactttttgttgctatgattctgactacattaggtatttcctaggagtgggatcatctaagtagtgcttgttcttttgtgactggcttactttgtttagcatgatgtcctcgacatgcatccatattgtagcatgtgactgattttaaggctggataatattgcattgtgtgtatatatcatattttgctttttatcttaattttaggttcagggggtatgtgtgcaggtttgttacaagggtatatttgtgatactgaggtttgggcttctgttgatcctgttacccagatagtgaagatagtaccaaataggaagtttttcaacccttacccacctctctcccaccctccttttggagtccccagtgtctcttatccccatctttatcatattttgtctatacattcatccatcagtggctattctgtaccatttatctgcacatctgtccttatggccaataccctaccatcttgattactattgctttttagtatgttttaaaatcaggaaatgggaggcccccaactgtattcttctttttcatgattgttttggctatttagggtcccttgatattccatatgaattttaggatagtttttttctatttctgcaaaaaaatgcctttgggattttgatagagattgcattaaatctgcatatcactttgagtagcatggagattttagcaatattaagtcttccaatccataaacataggatgtctttctctttttttgtattttcttttagcaaagttttgtagttctcagtgtatgagtcttctaactccttggttaaagttattcctaagtattttatcctttttgatgcttcagtaaatagaattaatttcttaacttccttttcagcttggtcattgttattatatagaaatgcatctgatttttgtgtgttggttttgtacctgaaactttgttgaaattatgtattagtcctcacagttttcttctggaatctttagggttttctaaatataagattctgtcatctgtagaccgatagttttactttggatcctttcctatttggatgcctttcatttctttctcttgtctgattgctctgggtaggactttgagtactatgttgaataatagtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggagttgaattttgtcaaatgctttttctgcatcagttgaaatgatcatgtggtttttgtcctttattctgtgaatattgtatcacattgattgatttttatgtgttgaatcattcttgcattccaaatataaatcctaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaatgatttggaagtgttccctcctcctcaattctttggaagagtttaaggagcattggaatttatccttttttaaatgtttgatagaattctccgctgcagccattgggtcctggacttttctttgttgggaggtttttgattactgcttcagtctccttactagttctaggtctgttcatattttttgcttctttatgattcagtcctggtgggctttgtgtttctaggacttatccatttgctctaggtcacccaatttgctggcatatgcttgttcacagtggtctcttatagtccttctcgtttttgttatatccgttgtaatgtcctttcatttctaattttagttatttaaattttctgtctttctttgttagtctagctaagggtttttcaattttgttgatcttttttaaaaaaaacaattcttggttttgttgatttttttcctattgtttttctattctccacttcatttatctctgctctaatctttattatttccttcgctctgccaacttttggttttatcttcttcttctagttccttgaagtataaagttaggaggctgatgtgagatctgtcttctttttatgaaaactttgatcactatagacttccctcttagtacccctttcactgcctcctgtaaagttttggtatgttgtgttttcatatgtctccggatatttttaaaatttctttgtgatttcttctttgaccattgattgtttaagagtgagttgtttaatttaaagattgactttttattgtagcaaatacatgcatgcctcattttattgtgtctggctttattgtgctttagagataccacattttttttacaaattggtggtggtggcaaccctgtgttgagtaaatctatcagcatcgtttttccaacatgtacccacttcatgtcacattttggtaattcttgcaacattacaacttttttgttatcattatgtctggtatggtgatcagtgatctttggtgttaatactgtaattgttttggggcaccaaaaacagcacccatagaaggtggcaaacttaatccataaatgtggtttgtgtcctgactcctctgcccattgtttccccatctctttccctctccattggcctcccttttccctgagacacaacaatattgaaataaggccatttagtaaccctataatggcctctaagtgttcaagtgaaggaagagtcatacatttttcactttaaatcaaaagctagacatgattcggcttaatgaggaagacatgtcaaaagccaggatagaccatcatgtggtttagatgtttgtctcctccaaatttcatgttgaagtgtgatccccactgttggagatgggcctgggaggaggtgtttggttcatcagggtagatccctcatgaacgtattggtgctgtcttcacaataagtgagttcttgctctgagttcactcaaggtctggttgtttaaaagagcgtggcacctcctccccacttgctccctctcttgccaaaggacgtgcctgctcctgtcttgtcttctgccatgattgaaaactccctgaggccgcaccagaagctgagcaaatgccggtgccatgcttcctggacagcctgcagaactgtgaggcaattaaacctcttttctttataaattacccagccttgggcattcctttatagctgcacaaaacggactcatgcaggcctgttgttccaaacagttagccaagttatagatgcaaagaaaaagttcttgaaggaaattcgaagtgctactccagtgaacacgtgaatgataaaagaaaaaaataaaaagcaacatccttattcctgatagggagaaagtttgagtggtcagaatcaaagatcatacgaggcacaacattcccttaagccaaagcctaatacagagcaaggccttaactctcttcaattttatgaaatctgagagaggtgaggaagctgtagaagaaaagattgaagccagcagaggttggctcatgaggtttaagggaagatgccctctccataacataaaagtgcaaggtaaagcagcaagtgctattgtagaagctgctacaggttatgcagaagacctagctagctaagataactggtgaaagcagctacactaaacaacacattttcaatgtagatgaaacagcgttacattggaggaaggtgccatctagggcttttatatgagaagtcaatacctgacttcaaagcttcaaaggacagactgactcttgttagggcctgatgtggctggtgactttaaattggagctagtgttcatttatcattccaaaaatcctagggcccttaagaatgatgctaaatctctgcctgtgctctataaatggaagaaaacctagatgacagcacatctgttgtagcaatatgatgtactgaatattcttagcccattgttgaggcctactgctcggaagaaaaagcttcctttccaaatattaccattcatttacagtgtacctagtcatccaggagctctgatggagcggaaattaatgtttttatgctggctcacacaacacgcattctgcagcccttggatcaaggagtaatttcaactgtcaagttttattatttaggaaataacattttttttttttgagacagtcttgctctgtcacccaggctggagtgcagtggcgcgattttggctcactgcaacctccgcctcccgggttcaagtgattctcctgcctcagcctcccaagtagctgggattacaggcgcacaccaccatatccagctaatttttttgtatttttagtagagacagggttttgccatgttggctaagatgatctcgatctcttgacctcatgatctgccctcctcggcctctcaaagtgctgggattacaggcgtgagccaccgcacctggcaaggcatttgctgccattgatagtgattcctctaatagatctgggcaatgtcaactgaaaaccttctagaaaggattcaacattttaaaagtctttaagaacatttgtggggccaagcacagtggctcacacctgtaatcccagcactttgggaagtcgaggcaggaggatcacttgaggccaggagtttgagactgcagtgagccatgattgtgctactgcactccagcctggtcaacagagcgagaccctgtctcaaaggaaaaaaaaaaaaaagaacatttatgattcatgggaggaggccaaaatctcaacatgaacagggaagtttggaagaagatgatttcagccctcatggatgactctgaggcaattcaagacttcactggagaaagtcactgcaaatgtggtagaaatagcaagagaactagaattcgaaatgcagcctgaggataggactgagttgctacgatctcctgataaaactttaatgggcgaggaattactgccaaaatagtagtttcttgcgataggatctactccgagagaagatgctgtgaacactgttcacatttcatgacaataaagggtttagagtagcacacaaaccctgatgaagcagtggcagggtcgtgtggctggagcgtggggaacgtggcccgggctgtctggctccaaagcctgtgcgccttccattgtgctcggctgcttcccgcacagatttccaggtcagccctgacatctgctcaggaaaaacgcttgatataatgactgcttgcaaatcatccttcttttatgccccatcctgtctgtgtactatttgtgggagcaggagcagcagtcaggagtgagggtgactctcagcaaagatttctcagattgcaggtctgatgttgttaaggggatgtcggggccaaacaccaagtaaggaaacaagtcctggctatgaacagaggcctgggtcttacacccccacatttcagccacatatgaaagggctcctaggtggcaattactctcagcaattttatcttagggaagaagggagggaggaagggagcaagacaggaaggagtgaacgaacacgtgaaaaattatgcttagtagccatcgtgttatatctaagtgtgtacgtgtgtgtgctagcacttaaatggtaaccctcctcccagaaacattctaaggcctctgtagacttttccttataatttacagaatatccgtttgattactctaataagctattgtcagcatatagctgccaactagaaatacatatttttctagactgagtgtccaagactctgggttttgagtgaaagtgtagtgattcatgtattttggttcgtttctggcatttatgggcttcggtggatgggacttcccttccatttggaagctagaaataagaacagtagcatctaattgctactctgtggtaaagttcctatagatctctcattaggagagaattttgaaaacagaaagaagcaggctgggcattctgaatattaggattaaaataacttccaagtcatttcaaatatgtttacaatcaggtaggaatttttctgtaatcagagttccaaattaaatgagttggggcatctgtggtgtgtggatgggtatatgtttgttttcttttctccgggggtttttcagcctggtgcttaagaacaaaatcccctttggaaatagtccagttcccagcggttgtgctttgtgttgccaattaagacttcgattgagggcttgatttggaatccttgggaaaagctttgtttccattaggcaaaggaaaaaaggcagaaaatccagggaagacattgtaggtcataccttgctcagtggggatgcggaggctgacaatggagtaacatttctactggttcaagaaagagacaatcactgttctctgggctcataagtagagcatgacaataggccaagctatgtgaacagagatcaaaagaacaaaactggtacaaaaagcgttatttaaaaaatgctctgtgacaaatgtgagatagactggtaaatatctcttgcttccaaacaaacagccaatagtcctttggaaaaatagttccacttgttagaagtacagcatttgtaattgcactgaagccagtgctgggtacatagcgtgatttgaagaatagaaagccaaaatctggcttcagttgatttttaagaattatttctaatatatttctctattattccgatccattgaaacgtaggtgataaatccatgtttgagtctgttctcagtagcaaaatagaggtggaagtattgtcctgttgaacaaaggaagacctgcgggacctgtccccttatcagaagtgatatggttctccccactagctcgagtagttgactttgtattgtagaaagaaagacttatgtatatagaattctctaagattctcccagaccactagccttcctgaaaaatgacttggattttgccgaagatcagtttttagacagtgaaagatatgagcatttgttaatttaattactgaagtgcgttatctcagtctgtcagaattatctcctaatttgagggacaaaagccaggtgggtcctggtcccttgtggaccctccagcactcagcatagcgcacagtggatggttgatgcctagtaagtgtctgttgagcagatcactgcttttatccagtgttagtcgccccagctgtcaggacaaatgaaatcatcagaaaatctctggtcacacataagagctgtctgtcagatttctgttttggttgtaaaagtttgggatacttttgcaaaattttggaaaatcaatttttgattcccaatcacatgatgaaagaaaacctaattgtagcttcttatgcttagaattcttattaaccataagaagaaagacatctgtttttcttatggtcaccagtctccctgcagaaattttattatgtctaaagtgttaagtggcacaaattgttgaatgcatatgcaatgtaatataaagaaccatttattttcataacttacaaggttgcaggtttgggtgtgcggacagagagcagaagggaaaacaaaataagtggtgatgtctatgcatttctatacaaaaaatacttgccttaagcactaaaaaatatactgcattattgcacagtctctcacaagccagtacttctaccactttcaaaataaagagcattatttttcactcgccgtccagagagaacatagcttctttgatattccctgctggttatttgaggaggcttcctgcagtgagtgtacggtattgctctctctggctgcccttgttactgcaaatgtcttgtctttaagctttattttctgtccttcactttgagtcctagtaaatcctctttaattcataagagcccttggttctcaaaaggaaatgtcttgttttttattctacgtctgggacaacagtaagatttttttaaaaagtttaacattttaatgcaaatatgggaatgacaaatatcttggaagagttgtgaaggattatatccacgtctatatttgcgaaccaaaatgtctttcgattttgatgtgtgcgtcctgcaatttactgaagcttatcaaaatacttttccacgcttttattaattgcactcacatttattctgctttatttctgtgcctcttatatgtagattaaacagatctgtgagtcttctcaatgcttgcaaactgaatagatcgacaccaaggtgaggggaacttagatttactttgtcaccatagctgttccttccattgtttccatctctgttttaacgtagtagcttcaaggtcttgtccagtgcctaccattcatcaagtcatcaatcatgtaactatattaatcattgacatttattgtttttttagatgctcaactggtcctccaaaacagtatactttggcggttcataaattgcagatggtgttaattaggggcctaatagagagaacacagggttgaagtcaccagccccaccacttgctgtaaccccaaacaagttgcttcacactcctgaattcggttcttcatctgtaaaatgaggataatgatattgctgcaggggatttgtgaggtttgaattaagtaatacagtatatgtaaaagtccagagtatgccttaaacgttaactgtggctgctgctgctgcagttttcatcactggcacccccgtgaactcttccagccaccaggttgagtgttaattattagaaaatcagttagtgtttgctgtaattgatgaacagttgtggtttttcagctctttaagggtgttttatacagttctttaagttgctatgaacttgccatgaactcccacaaggacgccccagaagctgtgctctgggctcttcttgcggctgcaaaatctcccagggccccggcagctggttgggcaaagtgtgcatcagagccttgtactaaagactgggcggagaataatcctgctaagtcaaattagcttggtgtttgtcgtcatgggaacatcttgaacttgaagcacaaaggctcctataatttttagactttaatcccaaatttcagaaatgtaatgctctcttaaaatctgtaatttccttgtccccaaattgagcattctaaaaacacacattttgaccttaaggcacaccctgcagattgcagttgtaagattctggcactgtccactcaggggttccccagttaacaaaaagactatgtggaaagtgtattcagataatcaccctgagagtgatttcaaagccagcataccatgagggtttttaaaaacctgcttggagattactaactgagccactggaagttgcaaaggaaggaagagtgaaagttgagctaaggagggtgtatagacagaggagacagagaggggaaggaaggaagagaggagagagtcactggctaccaagaaggagagtggccagccccaggcaggagctgcctggatgggaggcttgtcatttacttatgaggagggaggacgttgagcttcagtgcaggcgcaggggtcttgctgtgttaagttcctcagctcctgcgtgctccttgttgagatctggtccccgtgcacccttcactgaagctgtgcccactggcgccgcctgagactccccacttcccagggctcaccccctcctctgtgcagcaccagcacatttacctaatcctgcgctagcctttgcgcaccactccttctctcctggtgtcgctgctacctctgactcctgtggtagcttctcagcccacgtctttaaacattagtttccccagggctcttctgtccttggtcacctcctccctcggtgatttcctctgcatccgtggctcagcacccgccagatggatagagtctgtcctgagctgtctcgcgtgttgcaggcttgtattctcacccacccacacctccagctccaagtgtcaagactagagccacccaagtctgtgtgtgttcccagagccctggccctagaacagccccctgcctgcccctcccctcctccttttttgcttacagagcaggtgctgcattaaagcagtttgtgtctcttctggtgacagggtcagtgtgtgatacttccatttatttcatcctttcatttaataaatgtgtaccaaacttttgtatagggctctgcaaagctacgaaaatgataaatgagataagatctcaagaaatgcgtggactaatgatgtagatttttaagtatgtacagagatacctatactagagttatgtgctctgtcttagtgagtttgggttgctgtaacaaagtccatagactgggaagcttataaacagcagaaatatatgtctcaccatcctggaggctgggagtccgagaccaggggggccagcatggtcaggttctgatgagggctgtcttccaggttgcaggcggccatcttctcacatggtggaaaagggtaagagagctctctgggcctcttccataagggcactaattccactcatgagggcttcaccctgctgacctcatcacctcccaaaggccccaccccctaacaccatcacattgagggttagggtttccacacatgaatttggggaatacaaacagtccatagtgtgctctaagaggggaacaatcagcctccactccatacctgggctctggtttacccctcatgcctacgaatcccctgtgtataggggatcccttctcctagagcaggctctttccatctgtgtcataacaacacattcaagccattcatttgatctttcccggaatttcgcagtctttgggaagacttccccaggctgccttcccaggcctctgagcactctagtccctcttgtcctatgaatgaagttggccgcttaacatggacaccacctccaaacaaaggcattgtacacagggtggaacgtttctgtcgttactcgtgacgtcctgttagcatttgtcccacgcctgcctttaggccagatttcttcaacctcagcactatcgacgtctggggccaggtgctactttgtggagtgagccatcccgggccatgcaggatttctagccgcaccccgggtctccacccactacatggcagtagcagtccctccccagctgtggcaacagaaggatgtcgccagacattgccagatgtcttgggggcaccatccccccgggttgcacaccaccatctggaccaaggttgtccaacccatgggcccatgggccttgtgtggctcaggacagctttgaatgtggcccaacacagatttgtcaactttcttaatactctattttctttgcaattttttttttgtttaattcgtcggctatcgttagcattagtatattttatatgtggcccaagacaattcttcttccaatgtggcccagggaaaccaaaagattggacatccctggaaagtgaagcctactcaagggcaggattgcttccctggaagcccctggagtgctctcacacggtactgttgaagtcttaatgcctcagtttctccatgactgtgaactgtgctagtggcctcagttaaaaaggcagagagagagcagagatgttattctatgtgacactctgaaaagctttttgatctccgttgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcaccttcgatttctagtacactctcctgacctttttaagttcattttaatggactgctttaagtttgtcagcagtattttctgagacacagtggctgaaaagttgtaattttatgatttatcagaggctatgtttcatattgatgctaacaccagaaatgtgaaccatttttctttatggtttcatgaaatacgtggactccaaatttttgagtttttctatgaggttagtttgtaatggattatgataagtatcagtgaaactaatagtaacattttgttcctgaatgctgctttttggcattttagcagcttgttttgtgtctatataatatatttatatctatataatgtactttgtaaagaaaatccagtttctctatgtatttttacctaacattgtactttgttctcactttttaaacattgtactttaattttattctctctgtttagtaaagctgaggaaggaatttcagcttcagaggctaagcatgtgttttttttcccaaatgttcatgtaaggagaaggcttagtcataaagcaatcgactccaacccacaggctataaaacttccaagtttgtaaatccatggtgattcagtcctataaaggaagcttaaactctttttcagttttattcctaaaagatgtctgttgtagaaaacatagagacacttctcacatctataacaggtcaggtccacggtctattaacaatttaaaaaaccattaacatgggttctgtcttcttctcatttagactattagtacttcttatcagaagattatgctaatggggtgataataccttggaaatgaggccaagtggttacagtggcaacagagtgtgaattagtgggaggtgcaacgtagcccaaagcttctttgaattcagggtaagcttggaagttgacctgaaatgtctagatcttggcagttcttagagacttggctcctcctctgcacatctgatttttattaagaatttccaaaaagaatctgcattgtgtaaactccagatccattttatctttaaaatcctatggctttggtaaatgtgctgggtaaatatttccatagaagatatttacaaagagatttttgagaaatgccacagtaggaaattttgatttggaaatgagggactgggaaaatttactaatcatgttcccaaactaattcaggcaactaaacatgtccatttaaaaataaattctttgtcttgttagaacccaggcgtggttgaggcgagcatagcacagagctggctgagtttcatgcatcatgcactgaaggggtttcagagacagttactgtctcctcttaggcaattgctggtcttgacagggacccataggagtaagagctgcagtaactcaaaagaagcagctaagactcggtagaagtgaaggttaagctggtaattcagtggctgcctgaccccttcccgcctttcttcctctgtattcccacgtgcgcagccccatgctcaggctgccttgaccccagcaccaaagcagatctggagtcttgctgagaaatgccaccctcgaggatgggacacagggaaggaaaggagtagggaggtggcccccatgtaatttctgtttttaaacattactgcgttcagtggactcaagatggcatgcctcgtccccatcgctcactcgacatgtccattgttcctgcaggctgtcctgtgatttaaaaaattgcccttgttgggttcctgtaggcagcaagacatggtggaaagggcagaggctctgcagtaaaagaaagatctgggtgtgtatccagttctgccttaatgtctccaagcctcagttttttcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaagtaatcagtgagattttctacaattcctcactttttattttcctcatttgtaagatgaaagtgttagattttgtcacaatccgcgttgcacttgtgtctaacgtagttgggggaaataaagtattataaatccttgtgaagctcacagttcttaaataaggcatcgggcgggagctggtctgtgggctgcttgcgatcccagcctgcccgctgttccagagccccattctcttccactcaggaaggctagttagggtgcatgtgagtgagagtgctgacgtcatagggatggcttccaccctgtgctgctttgtagaagaagcaaatcattcacacaggcagtgctttaacttgcagccacaacagattattagccataaagctcacagcttctcacacgccatgtgcaaagctgtcgttagcacatatggcacttaggcgcaaattagaaaaaggctccctttacttcagaaaaacagttccatctcagcactatttctcaataataatacttacagcagatagaaaaccattctgtataaattatacaaatcttactattgaacacaaaataatagtgtttgtggagtcctaaatattaaccttttctgagatactttattttaaagtaattacatgttttgctttcataaaactatattctttttctttttccttttttttttttgagatggagtctcgctctgtcaccaggctggagtgcagtggcacaatctcgggtcactgcagcctctgcctcttgggttcaagagattctcctgcctcagcctcccgagaagctgggactacaggtgcgtgccaccatgcccagctaagttttatatttttagtagagacggggtttcaccacattggccaggatggtctcgatctcttgaccttgtgatccgcccacctcggcctcccaaagtgctgggattacaggcgtgagccaccgcacctggccaaaactgtattctttatgatagtttcagtcttcttgctcccatgtctcattttctttacaaatggtcactggatttgagtctttcttgtgatatggaagacctttatcttagaatgtttaattttttcaaatactttgtaacaagccacaaaattttaacagcatttaatctttgcaccaacaaaacctctattaaaaacaaaagcaatatatggtagtattttactttatgtattattgatgataaatgaacgttaataattacatagtgattcatgtcatcatgaaatactacatttaaatagagaattggcaataacatcgtgatggaaggcttgtaaaatgtagccagtgaactaatctgatggagatatttttcaattaaaaaagtattttatacctgatagaaaattggctgcttatttagaagcacggttcatgttagatgttgctagattgataaagcatttcaattatcaaactggttccccttttgtaagtcttaagggaatgagctatgtcagctctataagcaagacactgtttcagctttactgaaagttgttgaaatgagttgattttgttagaataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaaaaaaaaaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagaaccactgggctggacaccttgagcgcctgtcctttctaaagctctagcatttggtgactatttcatctcagggctcttcagggcgcaaagttgtttttcctttacgatagcatcactgctgccgtcggctcaacagtactccttggctggggctctgggcccttcatccaccagctcctcattcccttttgtgccctgacacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatgtctttgtgtgaataaatgcactcttgcaatgttattttagatgtggttcatcatgtttccagcccgaagtacttcagttggacgtttaagtaccaaacaagtttcactaatccactcagaccaggccaccatctagaacaatgcccagcacacagtaggtgctcaacaagcattagtcgaatgaatctttttgccctgatcactataacaaaagaaggttaaaatgatgggcctttattgccacagccaagtgttaatcccagctctgctgctttgctttgtcattgtgaacaagtgacttaatctctttggggttttcctcagtagcagtaaaagtggtacctgcctcacagggtgcctaagatcccatgcataggagcctcagtgcagagctggtctgcggtcggctcgccacagtggcagctgtgagtgtcatgtctgcatcccagactgttggagttgaggcctgcacacttgtgtccctcccactcccctgcttgcagggctttttttcttggggatgtcttggaattccccagcgcctgtttctgtctttatcccagcctgaaaagcgaggaatcagaaattctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaaggaaataccagtggcccttaactcatgaataggcaatcaagcccagacctaattaaagacatgccgatctaagtaagaagataacatatttagaaaattctttttactttactataaaataaagcacagatgcagaaaaccacacaagcaaattcgtagcttaatgaattgttctaaggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgggagcctcccctggctctctagtctgagagcagtgcttttcagatggtgtcgtaactgcctgttaactttatctgtgactctgtagctctcctcccttcaccatgctgcacacaccgcttgccctcccttaggctctggaggcccaggccgtgccattcttattctttgtatctctagtactttacacagcacttggtgaacatgagtgctcaataactatttgttgaatggatggaaggatattgtatacgatcaggcatcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacacagtgttaaatattggtgtatctaaacatagaaaagataccataaaaatacagtattataattttgtgggaccacagacatctatgtggtccatcattgacagaaacacccgtgtctagcccatgactgcatttcatttgaaagccacagccattcaagaactatgtaaacagcaccacctatgggtagacaattttaacaccacattttacactggaagatgagacttacgcattttttactgaaaaaaatgtttcactcttcaagccatggggtcatttatgttttaataaatttcaaaatgataagtgctaatattcttcatattgttttagttttgagactgttagctgaggagtctggaaatacaaaggtttttgcagtgaaaggaggaggaagagggaagccatattaattaataacatgttggacgcattgtaacatatcttatttaatcgtgccaataacctgttcctcacagtggttgtattcccatttttagattaaggaggttaagctggtggaggtgaagcccctcacccaagccctagaacacggatccagctggcctcaaaatctgtgctccttccaccatgttaagctgggaagtattggttggaaatgtctatgaagcagtcgcttttgtcccaaataaagtctccagcaacttctaaacattttgaatagatggttcttaaatgaccctatttctaataaaaagctgcttaaggacaatttttgtagagtcattatttccatggtggagtattctgacttccagcaggaactttatttcatcacgtgaagtcatttttaaaagcagtcatgtggctgagcccagtggctcacacctggaatcccagcactttgggaggccaagacaggcagatcatttgaggccaggagtttgacaccagcctggacaacatggcggaaccctgtctctacaaaaaatctaaacattagccgagtttggtggcatatgcctgtagtcccagatacttgggaggctgaggtgagaggatggcttgagccaggaggtggaggttgccgtgagccgagatcacaccactgcacttcagcctgcgcgacagagccagaccctgtctcaaacaaaaagaagtcatgttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacacatgtcaccacgtgtcgaagacctgcaagatctggccccagagccccctttcaggaacatggggttaggttagttaatgtagatgaaagagataagagcagatccccgctctgaggcacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatacgtgttcacagctgcctctgcggtgttgaccgcactggtgtctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgtgctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcatacagctcccgtcaacagactttgttgagaggccacggtggcttcaatgttctcttctggttatcactgcacatctgtgtgtttgcctttctatcagttgttcagaagatttgtcatcattttgtgggcttatatgccaagatttgcatgcaagagtgaaattacctcctcccaggcttgccttttagaaaaggtggtggtgcattggcaggagtaatgggttctaaacaaataagctgggtttttttcaataaaaactcaactttctaaaataataaaatgtagcagtagtatattttctaaatacagcataccacaaagtgatacattgtttagagcatgatttaaagaaatgtaagcattttagtaccacctgatacctcctctctcaatgaccttagttgttaacattcctgctacctaatctgttaatagaaatctttcattcttcctcttacagttcttcagtgtcgaaggtccacgagcttccctgtatgaagcgttcagattcccttgcggattttctctttgcaggaagaacatagttcataattgcttttttctgtctctagggcaagttctgaatttctcatttctgtgttcatagcttttgcatcattctacttttgtgatcaaagtcatgataaaaaaatagttttcttatcttttgattccatacctggcttccctttgattatgtttctgtaattagatttgcctcgtagtcttttgtcagctttccttctgtcctcacctccttctgcctgtaaatttaatcatatatgtgaaatttggagttaagatttcttctgcttctgcttagcacacagaaaatgacaagaatgtcacttccaccctaaaaatgagaacaattcaggtatctacagtatcatagctattttaaggccaccatggagctgaggacagaaagtagtataatgaactgaagtgttactgaaaagtggcaagcccatctgaggagggacaggccccacggctgcttttgtctctggcagagtggcggggagaaaaggggagccctcttagatgggagtaggaaatcacctggaggtgtagaattgggaaaggctgagtgtggactggcaggagagttcagagtcctcaggggctctgggcacacgagaaccctccccccgctcagacgcactccgcttttccccagacttccgtgagtgtgcatggtggattgggagccggacaggcggctgagagagacccacggaggcagaggcatgccaggaggaaagccgagagacgttctccacgctcagggcctggaactaagtgccaggcagcagctggccacccccgaaggaaggatgaggaaagctgagagagagccctttgaggggtgggtgtgtagtgaggtctggggacctggaggatggagagaaactccatctgcacaccaagccccacaccaggttcttggcagcagctgtgtgtgccccggggagaggcaggattgctgagagccgaccccaccaccacccaccaggcacagatccttggggcctgctgaaggctgaagacggagaaccaagaggaattccacaggagctccaggcctcacaccagggcagccgctgtctattgtccaaggccctgggaatatagccatgaacagaaagatccctgcccctgtggaattgcctcctggtgggagaaacaaaatgaaggcagggggcaaataagtgctatagagaaaaataaagcaggaggggcgggggctgtggcgagcagggcgtgaggagggtttcagtatggagcagcgaacatgaatccgtacgcacggctacagcagtggcctgagagtggctgacttcggggaggatggtccaggagggcccatgagccaacgcctgacacggagcctgctgggccaggttcccagaacagcagggaatatagtgaagggagatgagctctgaagaatacaggggtcaggtgcagattggatagggccttgtaggccaatgtaagacccaggctttcaggttcaaaggctgtgccatggctttttagtagtattttcaatgaccatagtttagagtttaggaaactaagcctatagcttacaaaactacttaaaacacatttgaacagagtaaaacacttttaaagcatcaggaaagtagtaggctctaccaccccaccccatgtgctgcaggaaattatctggaaatcaagaatattaatatagaatattacttactacatcttgggattaaggatagtttttattcctggtgtttttcattgtgtttcaagtcaaaaattgaggaataatattaggaatatatctgctcaagtttttgttttaaatacacacacacacaaaatgcatatgtaatcctagcagcatttaaggcactatggtgccttatgggttcactatggtgaacccagtgcaccccttgactcccgtttatttcctgtgtcgtcttttgtatcttaaagcaggcagaagtcagggaagctaagcagtgcaaagcatgaactttggagtcaaagttgaggtcaaggggtcacccccctccctgagctcccttggtctccctgtccctgtctggaatggagacggtgccatctccccaaaggtggtgtcatgggaggggtgcccctggcagaaagtagtgggtctgcagtggcggccgcctctccttctgcccccagggtcccctcgtggaagtttctcctgtgaggtgcttgctcctagggatgtccagtctgcctgcggctgtctgtccttaaatgcttcctgggtttggtttcccaagtgctgtcatggggtggtctcacctgctcatggtgggtgcccagggtgactgaagtcagcaggggtgtccctacctctcccaagagatggctgagctggagggtaccacaccctggtgttccccgcttctctttctattttatgttcacccacttgtcttccgagaacagccatctgcttaggaggtgagctctaaaaggcctcaccaaaagatcttttgtcaggaatttgctagttttaaataagttctttaaataatctgtcagaagagtgtagggaataaaaacaaccgtttttacacatttagacagggtcattcccttcttgattaatcacattttttcctccccgaaacacttacttgcagtcataaaaagcacaactttggtgataaagtgaggattgcaatctcttgcacctatgagattgtttatgattgtttatgtgtgttcctttttgcagtgaaattggtggtgtttttcttattaacgtgtataacttatgcagcatttgtgtggcagactactgcagccgtggctttggggtctgaagtgaatgagatgaaacacccacagcaccctttaaaaactgtttttcgtttattttcacagcaaacccaaggagcctgtattcagtgcaggtaagtctgatttaatttatgtatgggaacccctcactcactctctcagaactcaagggacagaaaagaagtagccagcttcaggggccagccttggacacacaggagctttggtttgtgcaggcccagatggagctttgtacctggaggttgaatggctcagatagtgacagcgagactgcctttaaacagtcataaagagcaaacccttcacctaccctctccaaaaccaacgtaagacatgccagtaaggaggagagtggaatgccaccacctatgccatgatggaatttctagattaaaaggtgtctgttgccttggttattccttccttactaactggattctgttatcaacatttgcatttctcttaggggaaagtttcttatgcatcaagttatataactgtctaaaagtagcttttctttttctgcctatgatctcctaaactgcaaactaatagttcatgtatatctttccatatatcttttttaacaccttttgtaataaggtagatgctgttgtctagcatcttaaccttatttagaaatgcatttaaaatgcaaaaaatggacaagtatgtaattgatgaaatacattcatttaattttaattgttctagttttttcttaagttcagaattaaaacataaaagtcaaagttgtgtatttatcagcatgtgctttagtgttcatttcattttcaggaagcatgaaattactcactgaaaatgtacttgctgtaagctcgcagggccacattgtgagcgcacttgtcaggatccctgaaccgtgtccagattttaagactggggggcaggtcaggtgttggcctgcgggctagtgagggctccgggctccggggcaggcaggccagccacacttgcagtactccaccgtctctttatctagcccttctgtctctgtctccgaaatcacaagggaaacgccgggtgacacactgcaaaggtaggcagcatttctgaaacctcatagctctctgagcaaagctgttacccaggctacagaaacctttttcatacaggcaaacagatgctctccttgtatgaaaatgtttttgtgttgcaaaccacttcgattcattttaagttaaacgcatccctgagcatttactcggatgggctttaataagtggctgtaatttggatcccaattggtattggctgactgcaggaatttttttttcatctatgtaaaccttaagagagctatagggccacccctggatgtcccactgtttgacttggtatcatgcactgctgctggcctcttcccactagcgcctttgggtttggtggcgtgtgtgctgttatcctaacctgcctggaacaaacactgctttccctggctgcattttgattttagatgtagcctgtctgaatcaccagtacaaaacagtgccaaggctgacttcagtgctttttttgcctagttcagtaagttaaaattctgcagtaagtaagctcagtcctaaggtttcttaatcatcacatacctgtgatagactcatgtggatatttcatagacattggttatatacatccacactctgcattttttatgtgttgtggaaatagcattatattgtctttattcctaacctacattctgcgagctttctggcaggactgattctcttacaaagagagttgctagaatcccttttcatttagctgtcaactccagtctcctgcccctcttttcaagaatgtcaatcgtttgggtgcttttagattctttggttgtggtagccacacagcccctgatgagcttatatttgggtgaggtttaaggaagggaagaagcttcagaagagaacagcatgagcggtggcacagacaggacagggtgtagaggggggcaaagagacacgcctggccccagaggagaatccctgtgggtggctgtggcagatgaggtcctgtgcggtgagagcctggcagggcatttagacctgctggatccagcaaggaagagagcaggtgaagaagtttacatggaggaagggctccgtaaacctggtttgggccttggtgggtttggcagcagtgtgtaaactgacccaggagagccataagacagcctgtggtgatggggccccagtgcacctggggaagttggcaccagtgtgggagacattgtaaggggaggatccatgggacgcagtggctggcacacataggcagggatgatcgcgttcatgactctcactcaacgtcagccttaatacgcagtgtgaagagtgtgtcacgtgcatgcatttaagacctgaagcgcatacacacaataacatgaaactggggtgccctcttgatttttaagtaatactgcatgtggcattgtttgaaaatccttaagaataagacttataaaactaacttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttaccccgtgttgatacgttgttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcagttaaaagatacataaagatatatttttacattgcaatataacaaatccatttaaatattgaaaaatatttgtgaatttggatattgagattgtgtatacattgaactcaaaaactttaagtggatttcttgtgttagttgaattttgggggtggtattttttcccctcctgatgataaaagaaagtaaacagtaaaatctcatggaaaatcattgttggaatcaagttccttcctgccttttacaatttcgtaggtatctcatgtacttaagtaaacagaatatcaaaagcaaacaagatgcaaacttttgtttcaaactgtttatttttatgttacttttttccctaggatatcaattagaatgacagaagggtaaaagtttctcttttatactgaaaggctagagaggataaagcatttgttttcaggtacgctgggcactgaggtatcttactgaaatctttgttctttttgtagaagaaggctatgtaaaaatgtttcttcgtggacgccctgttaccatgtacatgcccaaagatcaagtggattcttacagcttggaagcaaaagtagaacttccaaccaagagactcaagctggaatgggtgtatcctttattcattgattaggtctcacatgaagttatcagtcaatcaatgcttgatgttaactgtagaaattcataaaacttaagtcctcttaagcttttaaaaaacaaaatgttttactgttacttttgaaaacttaatgtaacaaaattgactatatgttagagacctacagagttctaacaaagtaggagcttcataagagcggcttattatcaggagaaccaacttatcattcctgaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctcgtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagtatggacttggccagccttaggagccaaacttcaagtgtgaccttgactgaagggatgatagaaaaatatgaataccaaagtactgaatgaagggagtcaagtgaatgacgtaaatgaaattgacatatcacgtagatatcatcctactttaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaacgttcttgaaacagaggtgctggtagcttcatggcatgaggtttggaaaagtgagcttccaggggaaaaaacaactgaaagataagaaaatagaaactgtgaaaaaggtgaattaattgttgattatttttccattttcttattactttagaggaatcctgcagagaccacctttcagtctatgcagattttaagggaaaaaaaaaattttttttcaccttcaaatatttgagtacctgtttaatgccaagcctggaacacaaattataagatgttggtttaaatttaagctattgtgacttcatttagaataattactatttgagattatggaatcatattccttagaaattttttaaaattaccacctgtacctaaatttctcccccaaaatactttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaaaacatttattcagcctacttcctgttcatattttagaagatgtaaagcaatgaaatttgctctaaataaatggcatttttttggccattatttggcatcttgccgggttactttttacatccaagttgaagtgatattttgttctcaaaataaaataattttcaaggtttggaaatataatgcaaaaattttaacagggattcttatcccaaaggatctgaggggcctgatttttttttttttaccttttatgtatgtttgtgtgcatgtgtgtgtgtcatttgtaccctttgtaagtacttttaccatgtttaaaaaaggaattttttagtaaaaatttagctcgtagattacagtaaaaaaattaataattgactcaatagctttctaaaaataaaaccaaatcattgtgaaaatatgtattcacattacatcaatgactgtttcaactttactgcatgccttttgggggtcacatgtatttgtcatggaatatttgcaatttaatgttgtttaaattagtgatgctgatggtaatagttatatggtattttattgcctgtgcctgttgaataaagctgatgttttgtcagctcttaaagggaaaaaaaattttatcttgacatccacaaagctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtggtaagtcctgaaacaggtcattcctgcgactcagaaggcgaaggtaggaggatcgcttgaggccaggagttccagaccatcctgggcaacagtgaaaccctgtctctaaaataaataaataaataaatgtgattcctgttgcacaggtggaaatagcattagcagaacacggtcagtattgggacataactaaagagaaggaagagggtctgaggaaatgaggtctttgggagagctcttctgtgtggtctccttgtggtccgctcactactgcgctccgtgagacccctctcatgtttaattttccagcctcaccaacgcatgagcttcacggaccacattgtctcaacaaacagcgccacctctttggaggccttcttaacacatcatgtattaaaggcttctaatttgggtctttattttttgataaacataaaaatgtgttgcctcatgtttgtggctgagtcggctcttcccataattcatttatagcttttggtaggcatattacatatcttggaaggatggatgcgtgaagagatggatttatatatttgtatttgtcctggttccttggtcaatgataaaaatcctgttcacgaaagatggtatctttcctatttatgtactcaacatgactttttaataaagattgtagactaatgtagtggttctgagattgaaatggtattttcccagcagaggatgctttttccttcagtttgaaaattcttaagaagaaataagggaattaagatgaaatgaattaggtactagttgtctaacgtcgtggtgctcagagaatttgtcatgagtctgtaagaagttaggcattatatatttcttatatttaaatttttgactagattatatttgagcaagggaaaagtaaaacttacctgcaacatgtagatgttttgtaaatatccttttcttagcctagcagttcatcctgatcggatcacgatagcaacaggacaagttgcgggcacatcgaaggatggaaaagtgagttacgttaccttttcattgtttcataatgaactggtaacacaaagtaatttttagaaaacattgtgctgctgagtaaggctgcttagatataattatggtatctgaaaacttctgaacccctcactagaattttttattgtaaattagaagacttattgtgtggcagggtgcggtggctcacgcctgtaatcccagcactttgggatgccaaggcaggctggatctcttgaggtcagaagtttgagaccagcctagccaacatagtgaaacccgtctctaccaaaaatacaaaaattagccaggcgtggtgtcacatgaccgtagtcccagctactctggaggctgaagcaggagaatcacttgaacccgggaggcggaggttgcagtgagccaagatcatgccactgcactccatcctgggtgacagagagagactaagtctcaaaaaaaaaaaaaaaaaatactgactgtgaccttaaaaatccctggagctcatcttaatttcatcagatttttaaatagcattgttctgaacaaagaattcgctaattcttaaaatgtttatttatatgataagtattaaaaatatgaaggtaaacatttaataaagttaaaattataataataatttgaatgtacaacattttgccaaatttcagccaccctctgccctgtcctgtgaatgtcgtttaacagtcgtgactttaacccgtgaagtttgtgtctgtgtgcagtcacaaaagctactaggaggtttttagcacagattttgcaagcacttcagcaagactttaatttgcattttaaggcgttagagagggagcttgtagcttttttgatatctacttttatatagcttgttattgcataatattttatctgaaactaatttaagtacatacattttatcaacatgttttcatccagaaaaaatgaatactaccatatttcagaaaatattttagtaacattggattttaaatattaatcttatgctattttccattaatttttttttttttcttgagacagggtctcactctgtcacccaggctggaatgcagtggcacaatcacgggtcattgccacctctgcccccacaggctcaagtgatcctcccacctcagcctcctgagtagctgggagtacaggcacacgccacctcgcccggttaatttttgtatttttggtagagacagcgtttcaccacatcgcccaggctggtctcaaacttctgggctcaagcgatctgcccacctcagcctcccaaagtactgggattactggcgtgaaccactgcgcctgacctgcattaatattttatacttgaaaagagttaacagaaataatggaaatcagaccactattatgtaaataaatttacttaaattgaatgggtctttcaatttttttttttttaatgttaaatggctttgaaaaattctttgaaattagtggtaagctatttgttcctccctctagtggcttaaaagtatatttcagtttctggcattgaaattgaatcggtactttagaactagagaaaaatattatagttatctttcagtttacccatagagaaatccagagaggcctagtgaatgcccgcggacacccagctgcttagagattagactgaactagaacttggttcacctaacgcctgcctagtgtttctactaggtccaaggccagcaccttttcttactgataaatctactgattgctctatgatgttttcttctattaaggaagagaaaaattagcgtaaataacctaggaacacagttgagaggattttaaaccaattataacaattctaaatcttatttgtacataattgatgcctgttttgcccaagaatattaagctcttttttttttttttttttttttttgagacagagttttgctcttgttgcccaggctggagtgcagtagtgcaatcttggctcactgcaacctccacctcccgggttcaagcgatttcctgcctcagcctcccaagtagctgggattacaggcatgcactaccacgcccggctaattttttgtattttgtagagacagggtttcaccatgttggtcaggctggtctcgaactcctgacctcaggcgatccacctgcctcagcctcccaaagtgctgggattacaggcgtgagccaccacacctggtctgttaagctcttaatattatttggtggtgaccatcttatgaatttaggcatggtgacaccttagcaacaaaacagactttaaaagaataacccatatgtgagattccattttacttgtcatttttcatttctaaaattcagacacatttagatgcacaaattaaagtgtcagttcccatggtactattgtcaaaaattggccattcaaattctaaaacttggtagacctctccttactgttaaattatcaacaaggccctccacctcctgaagtcatcgggaatgttttatttacataaaaaggcagactcctgaaatgcagaaaaagatcttttgttttgacaaagtccgagttactgcccaagtaatcttgtagcttcaaggtaaagacacatgtgtatcaccatcacaattgatggctctgtgtttcttttctgaacagcaattgcccccacatgtgcgcatctgggattctgtgacattgaatactctccacgtcattggaataggtttttttgaccgagcagtcacctgtattgcattctcaaaatctgtaagtatgtgccctgtggatattgctgtcttcttccacaggaagtagagaatcaactcagggttgaagagggggagttgacacactcgatacctgcctgggtgtatgtacagatttggactctgaaacattcctgcttcccagaacccctcagtcagaggtcatatgcatgtctcatcagggacacacacttccttccaatcagacatctccagccacatgggtttggtgatgaaaacaggcccccagagatatcgtcctcactttccttaaggcagtttatgtgctctggccttgaatttcacctgcttctttcaagggtggctccagcgtgtctgtctctgccatcctgctactggaaaggggtcccgatccagaccccaagggagagttcttggatctcttgtaagaattcaaggcaagtccatagagtaaagtgaaagcaagtttattaggaaagtaaaacactaaaagaatgtctactctatagagcagccctgaggtctgctggttgcccatttttatgactatttcttgatgatatgctaaacaaggggtggattattcatgcctcccctttttagaccatatagggtaacttcctgatgctgccatggcatttgtaaactgtcatggtgctggtgggagtgtagcagtgaggacaaccagaggtcactcttgtcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggttgtaaagggacaaagatccatcttctgtaacttcttcgggctgaatagggatgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtccagaattggaatactgatccagatatttacattacccattgcttttatttcttctgagccgcagtcagagatcactggttggttcacaggaataagcagggttagtttaaatagcagaaaaaacttaaaaacgactgatgaaactagaatctaatgacaaatgtaccatagttcttgaaacataatttctgtctccagtctcccatttttactaaagacaaaccataacaggactgattagtttggaaaaataagccttagtcttgtatacttggcttgattatttgtataaagtgcagcaagaataattatttttcacataggctttttaaattggctttgatggaactctgttccataaggaatctcagataagaccttttttaaagccaagcccagccataggtttatattctcaaatacctatgggttgggtaaattcctctcctcttggggggtcccaagataacttggggctcctgggcctgtgagaaagtgacattctttacttaccacagatcaggaaccctgtacagggactgtggagacaaggtacaaggccagtttcccccaaggggcttctattgactctacaattcaatttgattccttaaaggaaagcatgccattcctgtgaaaaaaataaccagtttctccagttgtgtcctgttacaaacaaaaacaaattctttacaattatgcaattaactatattgccataaattaagaatactcacaaatagtttctaaattctggagagatcaggttgagagaaacaaatatgcttcaaattttgttcatagcagtatactttacttaattgttaaaagctctaaatagctcaaaagaaaagttttcttgtctttgaaaaaagcaaaggatcagcaacattttaagcaaagtcaaaaaagatgatttcaatcttctattagtttggttcatgcagttaactcctgttctgcttgatattcaggaacatttcagctccccatgagagtcctgaaagttttttcctctattctcatgttacaactttgaaagtaatcagaaacttgcattcaagagcacctgttaaaggcctatatctgattataagccaccttttaaataggaccaaaacaagacaagaattgtctgtggatgacagaaagtcttaggacagccacaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaacaaaatctcatagataaatctattcattttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacaggtgtgagccatcgtgcctggccaatgtattcaattttaatcactgtgaccataaggtaagatttttataaaccttttattaatcctttacaatttgtgttgaaaagcagatcattgctcagagaaaaacctgttgtgcttttattccaatgtttaatttacagaaaaactgattaatacccctttaactttagccaatatgttcacacagaatttctttacaagattaatttctctcaaactttcgacaacttgcttaaactttgagctttattctatctaatttaaaacaataatttaaccttttaatctaggcaaaaaaaaatccacatttccatgccttcttataatctattaccaaaagacatttcactttctttatacaccttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaaccctgatcccaggctgccactgtgatggcagagaccaagataaagtactgccacgtgttacaaggtcaagctcccaagcacacgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcacaaatccttttttcccattaatcaaaactttacaggagataaatagtgatttttaccattcattcagccagtttgcagagagagagagagagaaaggccagaagtctgactggtaagaaattcttaccattttgctggcatgccaggcttctgggttccctttccctgaggcggccctagtgatccagctggctgcaccacagccctaggggccaagccacatcataaaggaaaattatctttttctgtcctggccagagcaaaatatgtgtgacaaaacatagatattagccattcagctcagcacccagcacccaaaatcaaactggcagggctcagacatgcccctggtcggccccatcgttgttaatccagcctccaaccaggagcttcaacttacggtctctgggcaagatggtggccctgagtaatagaaaacataagaaagggaaaaaggagagagagaaaagcattccctgtggcagggcggggaaggtgaagagctcagggaggccagagaaagacctgcccactgcagtgacactgaaaagttcaggtggctgcctgttgataacgaagggatctttcccagcagtcccgtcagctcttaaatttccccttttggggaggaaaaagttccccatgtcccatgatcttgtacatgcctaattctgtcacccttagccatcagcaaagagtgcaaggcagataaacccaaagatgataatagcagttaacgtcccatagtgccaagcctgttcttagctgaaaaggactttactgagagggacctctaaccccctaaatcttaggaaggactctaaccttcctaagttgggcctggaacccaaggtctgtctagcgtccttgccttttattaagaggggcctttaacccactctgtcttaggagagactcctaagttaggcctctaacccaatcccatcctttgcccaggtgtgtgccccccccttacccaaaatcagccattcggtgtgtacagatgatttttctttgcatcaggggtctccagtatcatccctttggggttcaccagaaagatgttaccagaccccaccacttactaaagttagcctttggattggaggtttcctcagtattgtcccttctgtggtctccagaaagatgtcactggaccccaccacttacccaaagtcagcgtttgggttgggggtttcctcagtgtcatcgcttcatggtcaccagaaagatgtgatcataaaggggtcccaatccagaccccaaaagagggttcttggatctcacgcaagaaagaattctaggcgattccataaagtgaaagcaagttttttaggaaagtaaaggaatagaagaatggctactccatagacagagcagccccgagggctgctggttgcctatttccatggttatttcttgatgatatactaagtgagggatggattattgatgcctcccctttttagagcatatagggtaacttcctgacgttgccatgacatgtataaactgtcatggtgctggtgggagtgtagcagtgaggacaaccagaggtcactcttgttgccatcttggttttggtgggatttagccagcttctttactgcaagctgttttatcagcaagatctttataacctgtgtcttgtgccaacctcctatctcattctgtgacctagaatgcctaaccatctgggaatgcagcccagtaggtctcagccttattttacccatcccccattcaagatggagttgctctgattcaaatgcctctgacaatcccaacgtggctggcgggcagcctggctgcaagcaggggtcggacagggccttgtcatcttccaggcttcctcaggacgtgctggttcagcagacccaccctacactctttcaaaccatttcaaccacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttaggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtaggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaaggtcatgctccaagccttttttgggctgcattaacattttcccattcagagccgccctggcatagtggtagccccctttcagcgggctcattcccaccccagcccttgtgtatgacgccttcaccttagaatcgtttggccccgatccctgtcccatcatgggactttgaccccaggtcctgttagggttttttctcttttcgccatgtctgtaagattgttttcttcctcatttcatagccactacccttttaattcatccagtcatgtatttgctggctgttcctttcatttgcttggcacaccccgagtgcctgccacgtgctcgcacggcacgtggaggcccggaaatgtgctcaggcgtgaggtgggcttgctgcctgagcccctgcagccgcaggaagggcaggtatgggcaggggccgccagcacgggggctcctccaaagtggcacagactcaggaaagaccagcgggagccccgagctaaaccccaaatccttcccaacaggattcctcctgcgaggggccccttgggacttctttgaccgcctctaatccgttttgcacaatatgtcaaattcccttgccttgactgacctttttctatttctattttctattggaagcctatttttatagactcgaattcagatttctcatctttgcatctattaaccttagataaccttagtcacctaactttctctgctgcatgtctgcgaggcagaccttgtattctaaccaggtctgttccctgacacctgtgttcattccctagccccaccttctgatattctgggcaggtgtttaagttcttcttgctacgttgctaggttagaaggcatcagaggcaggttattatccaggctcaagaatgtgtaactgcattattaaatagaagcagtgatcagagcccaatccagtaggccagggtgcgggtcttggaggttagggtgtgggctgaaggtggcggaggtggcacctgaagtgctagatctactccatgggaccccaggccggttcactgagccacaggcagagtcccaggagtcaatcgcaggaggaactccctggggaaacgggcagccagagtcagccacgaacaatggacctttgtaaaatccattccagggccctccctggagatgacatttaccagatagggggtgaggcctagagatctgcattttaccatttctggtgattccatttgttcggccagactgggaacccatgactagcagatgagagcaaatgcttgcagttctgaagtccctctggtcccaactccctcctcagcaaagcatgctgcatgcccaccccatgcctggccctgggagaggccctggcatagacagaggactcctgggtgctccctgtcctcaagggctcattgtccagtgggggagacagacaaggaggaggtattaaggcccacaccagcatatgcttgatgtttttagcaagatggattcaatgggggaaataataggcattgtgcttgccttgaatttcttatttatttgtggctcacattttacttgttttcctacatgtctcttacgcgtcttaagagatgtgaggcatccgagtccctgtttttcctatagtgctctaatgaagctgtgtttgctgcggatttccaccccacggacaccaacatcatagttacttgtggaaaatcacatctctacttttggacactagaaggaagctcccttaataagaagcaaggattattcgaggtaaagttaaattatgatttttgctttatttttctctcgtatatgtgattggctagatgcatctctctgggggctctggtgatcaacacaatcccttgggatccctcacatagttgggaagcgtgtcacacctggtagataacgctggtaatgaagtgaagaaaaggacagagcaagcctgggtggagggcagggaaaggacctggacccagggagcaccaagcctcccacagtggcactggctgcagagagtatcagaagatgaagtcatcgggaggcaggcaacctgcctttgcaaaagacattagagactccctgtgccttttgtctggacgttgtggggctgcgagagcaccaggggacagcaccttttcccgggggtccatctgccaccacctccctgaggcttgtttcgaggacccctttattctggtgctcggaccctgccctttaggctgacagcatagccccacccttctccccggtcagtaccctcctccgcttgctgtctgcagctttatgattccccagccacttggggttgctagaaatcgctttgtcttagagcagttaatctcacagcagaagttatgtaatagtagacagaaatgcaaggtgtgcagggtggtcacagaagctgacactatccagcttgggaccactgcgaatctagatgttattagtacaaatgaaaggttgtctggaatatatatatgttgtatggattaaatatatatataatttttttactacattctacagaaacaagaaaagccaaagtttgtcctctgtgtgactttctctgaaaacggtgacaccattactggagattcaagtggcaacatcttagtatggggaaaaggtaataagtgattgttcccaaaaccaatggtttttggtaatgttgtaagagatcaaacatgagtgctttaagaattgtctattaatacaacgtacaggagtaggatgaaatttcaagttacagagacacacacatacatgtgtgcatgtgtaacttgaaaccacaaaactagaacagaggaaaagcggagaatagtaagagttactgaccttacagcattctgaaaggctctttaagcccaagctattatgatggaattaaatagctttattaggaaatcccctgacagattatgatgaaattaatgactacttataggtctgtaaaatatttaagttactatcctgatttatctagcatgtggcagacatttattgaaagctaattatgtgctagacactgtgaacatacaactgagtcagacccaaatcccctgctgtctgtgagcaaacagtttgctaagggagatgatgcatcactcagaaagcatgcgtccagttaagtccagtgagcatttatgagcacttaccccgtgacaagaaaaaagggaaaatccaccatcccttttctcaaggatcttagagtttgaattggggctgaaggtggagacggacttgtaaatgcaatttcagaagcattggtgacatttccagtatccctgctgctcttggctctaggtgtcttattcactgctcacttaatccttagaacaatcctgcagggtaagcagcagccccattccaccaagggggaactgagggtagagtaactaagcaatttgtccagagaaacagctcactagagagctgggatctaaactcagagcccacgttctcagccgcgtggtgcttcaaccatgcggcttcaacaatgcatattttccttcattctaaggtaacccatttcatgcttgtctggtgctctgcgaacgtctagaaattggatccttcatagattcatattgcaatgatgtgctcacggacaatattgcgttttaaaacctaagtcagatgagattagaaaatgggcagaggcaaccttttgacaatgtgctaatgatggttttcttggtgtgtttaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggaggtaagtcatcaaggctactgctaaaatttgtttttaaccttaaactgttatcctttttttattagtttgaaatctgtatcttacagttttgaaaattgtttaggtgaaatcacattatatgggagcaatgtattttattaaaatcctgaggcaggttaaatataactaataaaatagaattaggtttataaaacttgaggttgtaacacacttcatatttagaatatttttattctcaattttccaagggactgttacccacattttgatttattataaaaatctgtcttctcttttaactttttctttttctttttttctttctttctttttttttttagagcagggtctggctctcacccaggctggagtgcagtggtgtgatcacagtttactgcaacctccccctcctgggctcaagtgatcctcccacctcagcctcccaagtagctgcgactttagacacacaccaccacacctggctaatttttgtaattttgtagagatgttgcccaggctggtttggaactcctgagctcaagcgatcctcccacctcagcctcccaaagtgctggattacaagcatgagccaccacgcccagcctcttttaatttttaatttctagcatgttattttggagacattattgcattgagtgaactagtatttgttgagtatctacttcgtacatggccctcagctaagtgccaatgtgctccctagggctgtgactccttttgatacccggtgtacctccccattatctacttggcagccctgcattccggtaggcaccagaggcaagatatttaatattccttctgcccactcagtgaattttctcccccaggttccaggaaatcgtgagcagacactgcaaaattggcctcattctgaagggtgatgcttttcatccctagcttagaatggacagactttaggactttgaacccagatacacacaaaacacttatattttacatcagagagcaacatggcaccaccctctggcagtgtgaaaatttggttctgttgattatttcccttaataaaggaagatcttcatctgagctttggaaatcacttccccttgcctggagattctgttgtgagaacatttttaataataagatttgaccagcatttggttgaacatattgtgaattgctagagtcatagacatgcccaagtcatattataactgtaaagaaagctccaaagccccatctaatttcataaaagctattcactgtttgttagtatctgattcttcctcattagcatgggtcatcatcaacttgactcaaatctgtgctaacatgccacactggagaatgtgtgaggggaggctgcttctttcctggaacgggagagcctaacagcaaccgccagggtcaagctgcagcatttgttctttttatagtacaagaactttgtttcttcatcatagcaaattgttcttaatgggtgtattttgcaattctttctcttaacatttagattattccatatgtttatgtcgatttttaaactgaacagaatgacattgccaaagaacttaccattttaagttgtattatggcagtgttattattattattattattaattattattattttcagacagggtctggctctgtcacccaggctggagtgcagtggcgtgatcttcagcctctgcctcccaggctcaagtaattctcccacctcagcctcttgagtagctttccagctactacacgcaccaccatacccagctaattttttttgtatttttggtagaaatggagtcttgctatattgcccaggctggtctagaactcctgggctcaagcaatccacctacctcggccccccaaagtgctgggattacagatgtgagctaccacacctggcctatattctttactttctgaattgtatctactgttgctatcagaaattgtaaaaagtaaagagaaaactaaccagtagcattccttatttttaaattttgttgaggaaaatgctttttcttaacctcattcttgctgatgcttctaagatatataaaatgtttgtagtttaaaaataaggcttagggttttgatcactcactcaacagttggctgtggtatctgtttttttgagatggagtttcactcttgtcacccaggctggagtgtagtggcgtgatctcggctcactgcagcctccacctcctgggttcaagtgattctcctgcctcagcctcccaagtagctgggattacagccacccaccaccatgcccagctaatttttgtatttttagtagagacggggtttcatcatgttgcccaggctggtctccaactcctgacctcaggtgatccacctgcttcagcctcccaacgtgctgggattacaggcatgagccaccaagcctggccagctgtggtatctatgtgaaactctccatatatatgtatatacaacatatatatttgaacgtacattatatacatatgtgtatataaaactgttatagggactatcattatgataagtgttttgaatgactgagctaacaactgaatgaaattgtacatcttttcttttcatatgacttttcaatgcagattccagaacagtttggtccaatacggacagtggccgaggggaaaggcgatgtgatcttgattggcacaactcgaaactttgtcctgcagggcactctgtcaggggacttcacacccattactcaggtacgatcccactcagcaggcccggcaaacactctcattttgcattatatcagaccctaatcaagcattacaatcaggtgctttatactacgataaccttcctccaccccagagtgtctgtggctgctgaaagatgggaggagagaaactgttgagagcagttatgaagtcagcatgaagcctcggttcgtcatcccttacggctcctgagtgcgaactgtagtatctcagagcgcttctgtttgtcttggttatttgtagggtcacactgatgagctctggggactggccatccatgcctcaaaatctcagttcttgacctgtgggcatgacaagcatgccactctctgggacgctgtgggtcaccgtcccgtctgggacaaaataatagaggtaaacatgcacattacatttccatttttcttacagaaattcatctggaacatgtttatttattttttgcatgaaatcaacagtgatacaaagttgtcccaaagcaaatgttatttatctatttagagttgccttaacattgcaattgcatttaacagtgttacttttaacattgcctcgtggcctcagccatgtaattttgaagtttactgttgaaattttctgacaagaagttgttctttctgagttcattgtcagattttctgagtacagtctctcaaccatcctaagagctgaaaaatacttgttatgagcctgcattctatttacagtgtaccctttgaatgggaatttacaagctgtactaaacacacgattgaatatatctctacattttgagtttgatggtaaagtgaactttcgtttgaaagtcagctgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagaacccagctcagtctgactcctaaactctggttctttccactgcattgcactgcagcgaatcggaagctcattctctgttgccggtgccctaatgatctgtgcaatcccattgcacagaggaaatagcccttctgtaaaccaacacatcatcctttcatcccccatagagttactggcatgtcccaggtgctaggttcaagttttggctcccttcccttcattttcacggaaggggtgctggtcactggtggccagctgagccgtgaggtggaagggcccaaggggcaggcactgccactcagagagcaggtgtggcccgtgatggcaggaaagggctaaagggaacagtgttatatgttctacctatgccctggtggtccaggagggctgaaggcaatgacagctcctttaccaggctgttaatcatttagcctaacataagggttggagctctaagctggaagccagggaactgcaatgaagttctagctcctctgcctactggccttgtgaccttggacatctgtaactcagtgtccacttctcaaaattgttacgaggcttagatgaatgacacagacagaagtgctttgtaaatggtaaagcttcaagtgaacacgatttctgtttgtgtattagtggcagctctgagcttaattacagctcccactgtagaaagaaagcattgaaataatgtaatcatatatcaagtttctttctcttggttttttagattatccagtggatctcagggcctcctattttcattcccattgctacttttcttcctgatcttccttaatctcttctctcttcatcctaaacactcctgcaaagtgccctttatctaaaacacatgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggaggcccaagtccagtcgtctgtaccgcgaagccttggcccagcttcccagtgtcacctcatccctccctcccctgtgtatctctttcatggatctctttcatggatcattccatcttgtatccgagttagtgatgactgtgtgtgtgttccactggatcaaaacctagaacatgccttgctcatctcatgatccttccaggcctccatagtgttttgcacccagtgggcactcacccagtctccgtgtcatggagttgggtgccgtggttgtctttctggagcaatcaagcacactattcagtgagcttaccactcagcacggggagtcaactgaaggggctgggttctataagctgtgactttgtagaagggcatttacctgtctttcatcagattactgtagaaatgagaggatgtaagacaaaaagggaaaaatcctaaaaggacagaaatttaagtcaggctcaatggcttacacctataatcccagcactttgggaggcagagacaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaacatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaaagaggcctgttgtttctatttccccaggaacaggcccccgttcagctcttggctacatgttcgaagcttctaatgacttaccaagaattaagttaaaagcgaaacttgaaacagtggcccattacattttgagccttggggaatctgaggaaagccatagaccctctctcctggaaaaggaccctctacctccactagacacacacacactttttttgtttgttttttgagacaggtctctccttgtcacccagactgaagtgcagtggcacaatcacagcttactgcagcctccagggcttaagtgatcctcccacctcagcctcccaagtagctgggactacaggcatgcactgccatgctcaactaatattttatcttttgtagagacgcaggtctcactgtgttgcccaggctggtcttgagctctagctcaagcagtcctcccacctcggtctcccaaagtgctgagatcacaggcatgaggcaccacacccagccacacacacattttgcctacaatctcgaggatttgtggagcttctcaagccctgatcttgaggctgtgggagaagccttgattttggaatgaagcaagaaaacatttcaaagtgctgagcatttaaaaatgctttttctactcctggtcacagtggctcacacttgtaatcccaaccctttgagaggcctaggcaggaagatcgtttgaggctaggagttcgagaccagcctgggcaacacagcaagaccctatctctataaaaaatttaaaattgagctggatatggtggtccacatctgtattagctactcaggaggctaaggcagggggatctcttaagatcaggagttcgaggctgcatcgcactatgattgcaccactgtaccctcgcctaagccacacagcgagaccccatctctaaaaaaaattaaaaatagaaaataaatgctttttctagctgccctttcaaaatttcaggaactgcccagaccctgagcctcatattccaattgagttaatacctattcacctggcacctcctacacaccggatggtgggtctgcgtttgcagctcagctttgccacttagcagcagtgtctttgagccggttacataagctctctgaatttgtttctttttctgtaaattgtgatattccctgcctggctgtgttgcactgaggatcgaaggagacagtgcacacagcacctgccagggctgcccatcaggcactgcaggggttattattatcattgctttccaggttttgattgaacatttatgctgctcattgtactgtatacatttactgtggtttcagtcaaatatttttcctcccacccttcctctctaaaaaagcgtagcacttaaattctgttgctatgactgcagagcctatatggataaagaaagtgtagccctttgcaggtcataggtagcaatatcttaagtattgggctccatgtagccaacagaattcttcatgaaaacgtttgtatagccacacacacacatacgcatgcacacagacacacacacacacacacacacacacacacacacacactccacctcccatttgactctctttgagacaggtaaaccttctaactcatcaggctcccaccttctgatgactggcctcccaataggctgacggatgccagcatgcctactgtgtgtgtaggacacggtgacagtgctcagaatcacagtgtcccatggtggaggagatggatcgggtcacctaatccagcccctcatctgtacctcttgccattcaggtcctaggttaggcttagctcccgatgctgttgatttaacaggtcacttcaaagccatgttctaatcagccccagcctttattaaggttaaatagcacattaaaggtaaatggttgttgaagatgcaagaaattggcactgaaaagcaaaatccacatttctggggggcaggacatctgacagtgcctggctaggggggctcctgtggaagacaagggacactcactctgcgtcagtggacatgctgatgggatgtcctcaggcaggttagaaactgcagcaacagtttatccatttatccttatccatttatccatttatcctgaaaacaccaggggctcaccaccaccccttgagaatataacaggcaggagagttcagtcattctgatgttaacactcatttagtgggtactgtgtgcttatcagaggatacaaagcacttccatgtccattatcattcgactttaatattgagcctgcagagtagacctgggctcttctccccatctcaccactgaggaaatggcccagcgaggtgaaattagaagaccagtcctccactccaatttctcccatttgctctgtgctttccctcgccctgttggttgcaggctagcatccccataaggcctgtactcttggcctgctctgtctgcagcaccattgggaacaccaccaccccggagttgtcccagccccatcctcctgcatggtcctgcttcgccctggaaacctgggtgagctcttgcaggtggtccttcactgcttcctctcaccatatgccctggcactaggtattggcatcttccctgcccagagctttctctccatgtgtaaatgacaaagcacaaacacagagaaaccatgtcatagtgttgataatggcatagttttgaatgctagccaatatgctgttcctttcattagaaaatgcttatatataggaaattttctttgaatgaaagctgggaacaagctttcttattaagcaaattctgagtatttattaagcttttatgattaacaatttttattcatcccactattatataatcttcattttcttattaaacaacttactgtgctttttctcatgttgataacaggtggtttgtgtttgacacagaaacaaaagacttggtcaccgttcacacagatggaaacgaacagctctctgtaatgcgatactcaccaggttagactccaaaccattcactactttatttttttaatcaacttttattttaagttctggagtccatgtgcaggatgtgtcggtttgttacataggtaaacgtgtgccatggtggtttaacgcacagatcaacccatcacccacgtattaagcccagcacccattagctgttgttcctgatgctctccctccccctcgcccccctccaacaggccccagtgtgtcttgttccccgcccagtgtgtccatgtgttctcatcattcagctcccacttataagtgagcccatgcggtatttggttttctgttcctacattggtatgctgaggataacagcttccagctccatccatatccccacaaaggacatggtcttgttcctttttatggctgcatattattccatggtgtatatataccacattttcttcatccagtctactattgatgggcatttgggttgattctgtgtctttgctattgtattcactactttaaaatcccaacagaattgagattctgtgtcagtgtctttaaagaaaaaatttcacaagcctcctcagagtaaaatttaaattagacatgcacataattatggcatttagggttcttttccctcctttgggtcactgtgcttgtgttatggaaaatttcaaacatagacaaaattaaacagaatggaataatgaaccccatgtactcatccgccagcttcaatgatgatcagctctcagccagtttcctgcgtctggagccccacccaccacccgcctcccatattctgaagcagttcccagacatctcatcatttcatctgttaataattgtatatatcccaaaaagatgaggactctttttaacagctttattgaggagtaatttacatacaataatgaaccattataaatgtacagctcatcgattctttataagcttgtggagctatgcaacaaccatcactacagtccagttttttaaccttttcatcatccaaaaagtttcctccatgcccattagcagttcacttccaccctcacccccagtccgaggaaactactgatctgttttctgtttccaaaaattgctttttctggacatatcgtgtaaatggattcctacaatatgtagttggttgcatctgacttcattcacgtagaatgatgtttttgagattaatccatgttactgtgcacagagcagtactatattccttctaattgctgggtagttttccattttatggatatataccacatcttgtttatccatgcatcagttaatgatggattttttttttttgagacagagcctcactgcaacctctgcctcccaggttcaagcgattcttctgcctcagcctcccgagtagctgggattacaggtgcatgccaccacacctggctaatttttgtatttttagtagtgatgggatttcgccatattggccaggctggtctcaaactcctgacctcaggtgatccacccacctcggcctcccaaagtgctgggtttacaggcgtgagccaccgcaccctggccttatggatttagattgtttctggttttttattattattaataatgctatgaacattcatgtatatgcctttttgtgtttgttttcatttctcgggtaaattcttaggagtgaaattgacggattgtatggtaaacttatgtttaacattttatgaaactgccagactgcctgtcctattttacattctcgtcagccatgtgctagggttctagtatcatcacatcctcccaatacttgttattgtccttttgattatagtcattctaaagagggtgtaatggcatctcattgtggttttaattggtgtttccctaatgactattgatattgagcattttttaatgtgcatattagtcattccaatatcttctttggtgaaatatctattcagatattttgccaatttttaattgggctgtttgtcttactgttgagtagtaagtcctctttatatattccgtatatacagtctttatcagatagatgatttgcaaatattttttctgaatgtatggcttatctttttttctgtttgtttgtttttgagacagcatctcactctgtcacccaggctggagtgcactggcatgatcatggctcattgcagccttgacctcaggtccaagcaatcctctcacctcagcctcccaagtagctgggaacacaggcacacaccaccacgtctggctaatttttgtatttttgttagagacagggtttcgccatgttgcccaggctggtcttgaactcctgggcccaagtgatctgcctgcctcggcctcccaaaactgctgggattataggtgtgagccaccatgcccagccttcattttcttaatggggttttttaaagcacaaaagctttcaattctgatgaagttcagtttatcaatttttccttttgtggatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcagaaatgtaaaggtttatttccggatactcagttctgcccccttcacctgtgtttatccccgattactgtgaccttagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgtgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcctttgttaaatttattccaaaataagtgttttttttatgccattgtgaatggaattgttttctgaattttgttttcagttggttggctgctagtatgtaaaaataggattgaattttgcacgtagatcttatatcctatgacctttctaaacttctttgattagttttagtataatagtccctcccaatccacaggggctaccttccaagaccccacacaggtgcctgaaactatggataacaacaaatgctaagtgtactatgtttcttcctatatatacttgcctatggcaaagttaaatgtataaatcaggtacagtaagagattaatgacaataataataaagtagaacaatataacaatatattgtaataagagttatgtgaatatggtttctctttcagaatactgtattatacgtaatatttgcagaccacaattgaccacaggttactgaaaccacagaaagttgtttcagtcttattatattatattaatatcactacattttattaagtttcttctgtttttctgaggagaaaaagcattcagtctttcatcatgagggataaagatgccctttatcatagtgagaaagttcccttctatttctaatttgtttggaggttttagcatgaatggggttggagtttatcagatgctttttctgcatctgttgggattattatgtgggtttcatccttcatcttattttattaatatcactacattttattaattttcagatgttgaaccaacttcacattcctgtggtaaattccccttaatcatggtgtataatcccttttacatgtgtttgctaggattctattaaggatttttgcctccatgtttctaacagatattggtgtatagttttcttttcttgtggcatctttgtctgtctcagttatgagagtactaccggccttacagagcaaattaggaagtgttctctcctctgttttctgaaagagtttgtgaaaagttggtgttatattaaatatttgacagaatgtatgtgaatttggtgaaactacctgggcctttctttgtgggaaggtttttaattactaattcaatttctttacttcttacaagtctattcagatttcttttttcttttttttttttttttgctctgtcacctgggctggtgtacactagcacaaacacggcacactgcagccctgacctcctgggttcaagtgattctgccacctcagcctccaagtagctgggactgcaggcaggcaccaccacacccagctaattttttttagagacagggtattcctatgtctctaaactgaaactcctgggctcaagcagtcttcctgcctcagcctcccaaagtgggattacaggcaggagccaccaaatttctcttttcaactctatttttgcttcatgtagtttgaatgaatgattgggcagaggttatgcacaaataacttaagccagtaaggctccgtcctctgccagtggctctgtgggcaggttgaagggcatgttcaaagttcaggccgtttccatgtcggcctggcttttactttccactcacccttttacatctcctctatgcacatgtacagattcagattggccggaagggtgtctgaataggcaggatcctttcctgcctccactgtgcatgcaccagcctcccgtcagccaggaatgcgctcacccatccaataaccgtaacctcaagccagtagaaaccttggccctccccacccaactgccctagagatggtcacttccatcccagtgctactattgcccagggctccatatggagtgagcccttttaccacagccgcgtggtcctcagagcctgttcttccctgccaggaccgctgtgctggcccagctgctgcgaaggagtgagggcagcccagggaagaacatgatggattcaccctgtttttacctgaagttgagaagattttcaaataaacaacacttctcagattttcatgtcttgttcaatttacagagtctggaaatggttgtttttgtcagttttatagaatttcataattgctttatggggagaggattggccaaccttctcatttggccacagctagaagaactgccctcttattttttgtgttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccactgcccctggcagctcttattttttttaatgactgttttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtagctgggactacaggcatgcaccaccatacctggctaattttttgtatttttagtagagatgaggttttgccatgttgcccaggctggtcttgaactcctgagctcaagcaattcacccctgcccttggccttccaaagtgctgggattacaggcgtgagccacagcacagacctgccctcttatttttaatataaccacagtatcgttgtctcctccccaacccaaatcagcattgatgtcttaatatcatcagatggccagttatatgttccagttttcaatttacttttttttaacaatttgtttaaaccaggaagcaaaaaaaagcccacacaatggtaattggttgatatgacttactagtttctgttaatccataggtgttctctctctccctctattacagtaaatttgttgatgaaactggctcgtttgtcctgtagcattttccacactggattttgctgaatgcatctttgtggtgttgtcttcacgtgttcctctgtcccctgtatttcccataaagtgattgctggatatcgaggcttggtcatattcaagctgtatatgtgttgctgtatttttcctttaggaggcacataatgggtttttctcactttttgtgacattagtagctgttgttacccagtgcctagatccataaaggttgccaactattgatttccaatgttagcttttcttcttcatttattagatatagtacttctatgaagaaaaactttccttcatctacaattttggtacccagtggtagagttcatataggaaagtcagaattaatgcttgatttcattcactttattttccagtttctgagataatacatttgctttctgctcctctaacagtcaccgatcagtggtggtgatagtagtggtggtggtagtggtggtggtattggtggtggggggggtgggggggtggtggtggtggtggtattggtggtggtgatggtggtggtggtagtggtagtagtggtggcggtggtggtggtggtggtggtggtggtggtggtggtattggtggtggtggtgatggtggtgatggtggtggtggtggaggtggtggtggtggtgatggtggtggtggtggtgatggtggtggtggtggaggtggtggtggtggtggtggtggtggtggtggtggtgatggtgatggtggtggtggtggtggtggtggtggtggtgatggtgatggtggtggtggtggaggtggtggtggtggtggaggtggtggtggtggtggtggtggtggtggtggtgatggtggtggtggtggaggtggtggtggtggtggtggtggtggtggtggtgatggtgatggtggtggtggtggtggtggtggtggtggtgggtagtggtgtagttttggtgccattatggattgaagtttatttgctgtgttcctgtctgttatattaggtggaagttactctagttggctcctgggtccttttgacgtgacctcaggagcctttagtacttgttctctggcataacaagttgttccaggatccttgtatacatttcttacctatagccctttctctcaggaggccctccttcctttttcatctgaagggaggagatcacaatatgggtgttaggagtgcttgttgccacagggtaggggattgtcttgccttttcattatatgattatgttgtgggaaatactgtttctttcatgcacaggccatttggctatgctgacactcttggaaactggagttttggttctgggaaatacgtggctgactctgagctgctggtctctgtagggatcttctattttataaccttattgacagcgtcaactctgcctcacagtgggacgtgtcctcgagctttagaagatctgatagagcatctcttttggatgttttttcgttgtctctgaaccacgttcataacttctcaccctaaacagacaactgctcagcccccttggcagccttttgtccatgttgagaaggagcttgacttggaatgcctttcattcataacctcctcagtatcacatttctttctgttaatttagccagtgttctgcatcttatcttgtgtttctcaccattttctcagttattttgaacgtctgctgaaggcacgagggcctcatctgcagcctctttcctagaaagccatctgatacctgtcagcgcctgctaacttgagcaggtccattgggaaacatgtttctatttcttgtcagttacactaatgaccattccctggagagcagagagctcttcctactagaactctgcctctcagcttcagagtcattgcctgggagctgtgtggggcaaaagtgaaagccctaagccagggccgggccaaccgcatttgaatctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacgggttagttgcatgcgtgaatgtagctataactaactacagtgcaacagacacaaagcaaaatgtgatcagcagtatgagttttctggttacacaagatttttccagcatataggctatactgttgtggattactatctcatttttggatttaagtatttacagacctaagactaaagagagagagagagaaagcattcgatgcccaaacacagattgtcattgacatggaatttcagaaacctgctgccaagatcccggccgagatctgtagcccatctccaaggtagcagcaccctgcgctgccatgtgctaagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggacactgaccctttgccacagactggggttgtggagaggagctttaggaggaactggggctattttgcaaatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacgcaaccacgaagccaagccctccaggagtgcatgtggatcacccagagcgggtgggggttctttggcatgctcagagccatgagcctagagaatttccatggaccattgaatacccatctcaggcatgttttagcaactgtcatttatggactattttatataacatggtcttttgctgataaactaatgttacgtgaaagtttatcacaaccagtcagctaagtgttggcaaaatgccagctccctcaggcttattaaatacagaagcttcatagtgataattctcatatttaacatgcatgtcgagaatcttatagagcactttatgattggacaggatggagttttgattgaattaagattgtacttttttaaagaacagaaataggaagaaaataacttcctatttattaagcccaactgcagatccttagcctgcctgttctagtttcagctcattgaacctagggtaaaaatctgaatgtgaagatgaaagagagaagcccagaaaggactaggtgcaactggtcatgcaattgtgtttctcttctttgatcttatccatgtcattgtttgaaaggtggggctttttctgcttttactagaatgaatcagaatctggcacttactccgtcacttgcagtattagatcccccatctgcctgggtctgagccctgtgctgatgcaacccctgccacccagccaaccctttcccctgtcatgtggcattccccctccctgggttgatccccatgcagatgcagcagtcttgtctccaagcccaaaattacaatcagtgtgccaggagagaggctacaccatagctgcacggctgttcctacacctgcagaccatcttcgctgccaccccctccctccccaccccagatctcacttgtcagcttacaggtactttgcaagcatgcaaggatttctgtctgtgccactcacctggctgtgttgctgtacacaaattactaagcctcagtttcctcatctgcagagcaagtctaattgaaccctctgctgaggcgctgttgggcttgactgaagcccccagcctccagcctggtgaagagtgagcaatcagtagaaaacagccgtaaggttgtccttctgccctgagcacctggactcttgctcccgtggctttatgagttctccagctgattttcattttgggccaaatcctagcttatttcagtggagtaagtttaggaatctcagtctccgagagagctggggaatgaggcttagagagtttttggaggagaggagaacaattagggaaagaaaaagggctctgtgggacccaagaaacaggctgtgctaggtttcttctggcctctggttagcatattgacaaacgctggttggttttgatttcttaggcaattgtttttatatatttatggatgaatgtaggtaaaagagctaggatttgaacccaggtttttctgcctcgaaggccacattctaatcctcacactctgccgtcttgccgggcagtcgtcgcggtcaacgggagagtcattttgaggtttttcgtggtggttatgtcgggggccaggggctgggaggcacctcctctgaggaagggaacgtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttcaactcctgcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctatctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataaaaaaattagctgggcatagtagcgcacatctgtagtcccagctactcgggagaccatggcaggagtcgaggaggtcaaggctgtagtaagctgggattgtactactgcacttcagcctgggtgacacagcgagaccccatcccaagaaacaaaacaaaactaatggttccattatgaaagacacctcattatgttttgagttcacaaatgatcaggtagttcttttttttgagatggcgtgtcgctctgtcgcccaggctagagtgcagtggcgcaatctcggctcactgcaacctctgcctcccgagttcaagtgattctccagccttaccctcccgagtagctggggctacaggtgtgtgccactgcctccagctaatttttgtatttttagtagagacagggtttcaccatgttggccaggctggtctcaaactcctgatctcaggtgatctgcccacctcagccttccaaagtgctgggattagaagcgtgagccactgcacctggcctgatggggtagttccttgagaccttttgcataagagtggacagccaatcccctgccgtgtcatgtgacagattttcagctgttctttaccctaaagctggtcggaggggcagtgcccctggagtcagattgcctgggtttcagccagtttcaggaaacctgtgtgaccttggatgagttagtttattgtacacgcctcactgtcctctcttgaaaaatggggataattatatctacttcacgaggttgttacgaagatacgaaaattaaataagttaacacaggaagagtttagaattggacctagcacatagtaggctctcaaacatattggccaggccgggcacggtggctcacgcctgtaatcccagcacttcggggaggccaaggcgggtggatcacctgaggtcaggagatcgagaccatcctggccaacatggtaaaaccccgtctctactaaaaatacaaaaattagccaggcgcagtggcatgtgcctgtaatcccagctacttgggaggctgaggcaggagaatcacttgaactcaggaggtggaggttgcagtgagctgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattgagtgcagagacggttggtttctggcgtggtcacctggccttctcaagcctcatcagcagccgatgacagcctgtctccggcttcagcagtccttttgtttttctcagcaaaaaatatgtatttgccccattccttcagaattcttgatttggacaggctgccttggtcttacatcgcccctattttgtcctggcctaggccaacacttcctaaaataccattccctgaggcgccaggccaccctgggtcctgcaggattcctgcctggcagaaggaaaatcacaggaaagaaggaggggagaaacaacccttacctgatgctttacgcgcctgtgagcgcaaggccctgtacaaatattgtccaagtggagcctcccgactgctatgaaaatgcgccgcttgctgtgttttgtggatggaggacctgcagccccctagctggagcagagagacccctgctaccctgcattctattctgggccctgcatggctccaggtttccagtccttctttttgcttgctggctcaggaaagtctgaccttttcccggactcacctcctggccgtgtttcctgtcctgggcatcgtgagtccccctccctgcatagcgtgcacagcatggttgcttccagccaccagggctgctgctgccttttgttgcaaagggctccttcccatgtgtttccacacaagcatcgcagcctgggtccttaggccctcccagaaccagaaacccaggggaagaacataccaagatacccctgggaagagaggcaggaagggctgtccaggcagagagcagtgagtgcagaggcctgagtgaacccgtgtgttcagtgaggagcaacgtggctagaaggctgtcctggtgggctttctgggcccttccaaggaattgagtcttcatccttcagtgattgggacagggaggggcttataagatttcataaaattgtatgaaaagaatttgtagggggcagtggctcactcctgtaatcccagcactttgggaggccaaggcaggcagatcacttgagctcaggagtttgagaccaacctggtcaacacagcgagaccccaactctacaaaaaaatgtttttaaattggccaagtgtcatggcacacgcctgtagtcccagatacttccctaggatcacttgagcccaggaggttgaggctgcagtaagctgtgatcataccactgcactccagcctgggtgacaaagcaaaaccctgtctcaaaagaaaaaaaaaaagagttcataaaaatttataaatcgctggacgcagtggctcacaccttaatcccagcactttgggaggccgaggcgggcggatcacgaggtcacgagatcgagaccatcctggctaacacgttgaaacctcgtctctaccgaaaatacaaaaaattagccaagcgtggtggcacgcacctgtggtcccagctactcgggaggctgaggcaggagaatggcgtgaacccgggaggcagagcttgccgtgagtcgagatcgcaccactgcactccggcctggcgacagagcgagactccgtctcaaaaaaaaaaaaaaaaaaaaaaaattataaacctttaccaggttttatcatctggccagatgtgtgtttttcaaaagatagctttggaagtggcaaaggattcattgaaaagcagatttttctcttggaaataattcattaatctggtgattttgtctaaatctgtggtggcagctaccgttatcctttgtaacgaacaaaatgtgtattgttaacatctgaaatgtaatttgtcatctttttatagatgggaatttcttagccataggctcacatgacaactgcatctatatatatggcgttagtgacaacgggaggaagtacacgcgagtgggcaagtgctcggtaagcgctgacagtggacctgtcgcttctcatgcactgcgtatagtttaactaccgtggaacagtgttggcagggacttctaaggccaatgaaatgaagacagtgttttaccctcccagggtcattccagcttcattactcacctggactggtctgtaaactcacagttcctcgtgtcaaattccggagactacgaaatcctctactgtgagtaccaccccggggttgtatgaagtctcgatctcagaaagcgttcactctgagatccagggggcctctgtgagaacccacctcctgtatgacttaggcacgtgccatcatctctaggtcatggtttccgcctctgtaacgtaggggagtggggctgcgtggcttcttgggtccttcccggtttcctgctgactgtgagcccctatggaggagaagatccagggcctgccccaaggggaagaaggccaagccctgcagaggggggcttggggcaggcggatgtggcagaagggggcgggtccgggtggatgtggccgaagtgggtgggtccggagctgtccaggcaggaggagggcctgtaaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagcgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcagggacaagccctgggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttggacggagatgggaaaaaaacaaagaagagggcacctccacccaggcccatgggctcgggctcagttccaggggaactcacatctgtgcacacgtggttcctgcccgactgggaagtggaaggtctccctctccaggaagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgtttttggtaagtttgctgcagatttcactggttccaacaaaagagtgtctccttttaaaatatttcttcagttgctacggagtctcatggtcaccagtcttgtcagattgctcggctgctacgggaggcccatgagacacacctcctgccgcaccctggggtagggcctgggcttgcctggccgtggcccactgagaagaaccagagagatgggtttttaacccttctccactgtacagggcagcaggtcctaagataattccctggaaccctctcctatcaggttgtgccacatggacctaggtggaccagatggcactcagtcaacttaccatttgtgagggttattatttatatattttttgttcttaaactaaaaatttcactttcttcaacattcactttaggaatattttcataagtgaactaaattaaagggctgcaaattaatagaatttttaaagatagtgtttattgtctctttacgtaagactacaagtcttgtgagaatttgcagttttgtggtgttcagtgctgaggtccggaggttcactccagagctcccagtcgaaaacccaacgtgcatccagccctctcctagccacaggtattgttgaaagggtttccccgacaatggtcagaagagggcgtcccccacccacccattctccaggcccacctgggctcacccgacaatggtcagaagagggtgtcccccacccacccattctccaggcccacctgggctcagggatgcagagcctggagccagtaatgatgggcacagctgccaggctgccccaagcaagcaacagccacagtgagtgaccccaagaaacatgcgcacacccagggttaaaaggcctttggagagacccacccatgtagagttacagcaataacaaggaaactgcaggcttgaggacagggcagcttcccacaagatgcttcagagatcaaggagaggtgtcactttggaactggggttcctggtactgtctgccttggcctcaagatgaggcctcaaaagacctggcagcccggaaagcttgtctttgctccccttgcacagcagagcatcagagggtctccgagactggcctgagtgagaggagactgggcgcacagcgagaggccaggaactgaggctattgtgcttttttgacccttgtttctaaagctggacttcaggcagtttcatgttcaggaccgttcagtgggcgcttcctgcgccatgtggccctgtggcccctggtgtttccagcgccctgtttgtggtctttgttttaggagtgtggccagaaggctcggacggaaccgacatcaatgccgtctgtcgggcccatgagaagaaactcctgtcaacaggcgacgactttggcaaagtgcacctcttctcatacccctgctcgcagttcagggtaaaggacttgtttcttcactaatcttatcccccatggggcatgcacgtacacccgacctgtttggagactaagtggaaatgggctgtgagcgactgctgccagccacaaaggcagatgtgactctgttctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcggctgagggcggtcatttgctcgtgtctgtcccctaccaggccacgaggactgtgggctttgtttctgtgtcccttctgtgtcacacacagagcaggttcccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaa

SEQ ID NO: 1404 - DNA, 148651 bp, Homo sapiens; identical to SEQ ID NO: 1403

SEQ ID NO: 1405 - DNA, 247008 bp, Homo sapiens
ggacggccccggcgcgcgggggggcggggggcgcgcggggtcggcttatcatggcggatcggacggcgccccgctgccagctccggctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcaggtaagggggtggccaggggcggcggggaggggttgcgtgtggaggctgggaaggtgggaagcggttgacctggggtcggatccgggagccccgtggaatagaggattctctctggagccgcatggaattactgaagggctgctgattctagggccagggcagaaacagtgtggggagtgtaggtgaggagggagagatgtcttttcgctgtatccctccggaattctggcttttaaatctccaaggagttgagtgttctgatgctttcttgctgttctttcctgctacaagtggaaggagcctgggtaactatgaaacacttcttccttccctaaccaggtgcacggtaggaccaataacctgaagtgtgggcatcatctttgggaggctcctcagtgggtttctcagtaagcaagaggattaaaaaagatctaaaagaaattttactactggtaatttggaatcttcatctcagatgctttggacctgggaaatttctgcagtgggtggggagtttgttctctaatatttcacttggcagtgttttaatgcccaaagcatatttatacactaaatggatgcttccacagcatcattgaggttattaaaggctggcagctgctggatcacaaaatcctaccagccagcccacacaatgaccaacatctgctagcggatggcccaagactgactgacaggagagctcatttggatgaatggccgttttaggggccctcccgattaaatggaaaggggttatattgtgattcttggccctatcctctcatctttggaccagacacattttcctccagcccttgtcagcttttatgtgagcaaacaaggtatgggccagatgctgttcacagggaatccttttcagccttcagcagttaaggaagattttcgtcatatgggagcctcagcccacagggaaaatgacttgctgaggatggactacaactgacagagaccatatttataccttccaaacttgtgtgtttcattgatgtagaacaactaccattacattctcagaatattgccacttttgctctaagtttgtctttcacaatgaaataaatgaagtgatgtcatgtccatgctcctaatttctcagtgcagagaatgatttcaaagatcagcttttttttcccttcctaatgatgtgcttatattccagagccttttttttttctgagacctaaagttgaaaaattgttacagaaggcaagcacttaatattcaaactacagattttaaaaaatcttgactttttttgaagatgggagtgctaatgttctcaagatttagtggaactagcatgtaaaacttttttcatgtcacgtatgacacaaatagctttttttcttccctccctaacatggtagttgttgtgcttggggcatccttacatagttttgttctgcagattttgcttctctaattgctaggctgattatgaaagttacaggtgcaaatgattaacaatgactcatgaaaaggttagatgtttaaaaatttaaacccattatgtttttgctctctctgtcttaatgcagtgctttccattacagcatcaaaataagatgtagtcctttgggtgaagggagagagtggcaattaaacagaaaattctctgtggttaaataatattaatgtgacagttcactgaactactttgtggatttgaactcctaatcctaattttttctctgatacaaggaaaaaaaccaaatgcactgttgaagctgaaggtgggaaaagggtggagttgcagtaaaccgttgttatgacaagcagccgggctagtgggatgtgatgaaatctagcttgggtggttaaggaaacattcagatttgaagaaaaggtgaatgaagtgatgtgtataactgggtttgcagggagccttaactgatgaagggaaaaagagacagttagcatctgatctattcattaagctactttagtgacatagtagtaagcctgatttcagaggaaggactgtattcataattctccacaatatttggttgggtcagagtatgtataggtgagcagagcagagcagagttccttaacatccaaatatgtctttgtacacaagaataaaattaagttcaatgaattaagaaacacaaaccacagattattatggaattaagagctatgaaattggaatgtttatgctgttcttttgctttgtcttacatatgtaaatatctttttctggtgaagacactgcacaaaccacaatgcacaattttttgtccttatgaattttaattcgtttctgtgtatcccggttactactattcttccacctgaaatattgaagtttgttattaaatggagaggactatagctaaggttctaatgcaaaagtgttttggttttttattgaatcattacatgaatatcaaaacttgttcgtttctaattcttgtttccatcaggtgagatagcataagtaattgtccacttggtacatagcttttgcattagtttgaaagatatattcatatgcatacatctatactgctttattttttgtgctgttttgccaagaatattaactagaaagcagcccaacaagtattgataacacactccattttataaaaccatgtgatctccaagatcataatgaaccctaataataatgtaggttttggcagagctcattagggctcagcatatgtgtccttctgctttgacaggctatatgtctaagtcagatttttaaagatgttgctatgtgaggcataatataatttactgaatgtggaggcttagttttattctcttgaatattactttttaattcagataacagattagaagatgatgccatattttagacctgataacattgtgatagaacaagtgaatacttaaagtaatatttgctattgggctaacaacaagatgcaaatcagggcttgataccaaggacagtaatagagactgggataattactaacttggtttctactttaggtagtagaacatgacacagagaatgggagtaaatgaaagaaaagcctgtgaacacattcatcctctgttacttcccttccattttcacagtgattccagttgagacatttatctcctcactctggaccactatatgtattgcttctggctagttccctgtctccaggttcttctgcctcgttttccggctcccatttgcaaaggaggtttatgtacaatgctgctttaggggaaagggcactgacttcgttatcatgcacacttgggtataaatcccactctgccatttaccgggggtatctgggtgagtggcatcacttttcagggccttgtttatttgtgaaatgggaatgacaatacctaaactgcagagttgtaactattagaaaaaaatgtatgcaaagggtttagtgtggggcctggcccttagttggtgctcaataaatattcttagttgtggtagaagtagtatttcactaaacacacacacacccccagaacaaaacaatgattcatcattgctcacaggcagaagtccagattcctaagctttctgttctctctcctaacctaccatcctatccttattttccttttttaaaaaatcataaattctttgcttcccacttgccatatgatgactctgttcttccctgcctcacagtggaatgattcatcttccccgctggcccttctctgtctgtccagccgcacccctccaatggcatagcagtgggagcttggactttgctgtcagtcatacttgagtttgaacctaggactgccaccagctggcgactttaataaacctcttcgaatcttaactatctcatcagtgaaacaacttttcacttataaaatggagttttaaagtatctcctttgtagtttgttgtggggattacatacaaaaatgtttggccagtggtaagtgtgcagcaccagggtcctgtttgcatctgcatcctgcaaagccctatctgctgcagtctcacctctcccatgagaccttgtaccatcctcagatgaaggggcaccttgcacttccaaaactttgtgtgttttgtgaccgatgctgctcacttaatatgtatcatttagggctatcgtttcattctgttttcatttgtaagcgtatataagactcttgaggctgagagtgaattttataaccagagctaacatttcctgagtgccaaactcagaactaaatgtgtatatcgattgatctgatccaccctctcacagtccagtgagataggcactgttgctaaccccaggctacaggggaggcagctgaggcacagagaggttgaggatcttgcctgttgtcactgtctggcagactgtggaatgggaattggaacccagattggtctgattccaaagctgcaagctttggcttcactgctttatggcctcttatattgtggtccctacaactgtgccttcttcctaaccagaaggtagtagattgttgctctttgtaacttgcttatcctctgttggtctataaaccgtttgatttattcaagaatatttgaagtagatcattagaattctgcctggaaatgggaccatgtttaagtttgctttagaaacatccccagctcggccaggctaatcccagcaatttgggaggctgaggtgggcagatcacttgagcttgggggttcaggactagcctgggtggcatggcaaaaccccatctctacagaaaatacaagggctggctgggcatggtggcaggtgcctgtggtccctgatattccgggacctagggccagagaatctctttggcccaggaggcagaggttgcagtaagcccagtttgtgctgttgcactccagcctgggcgacaagagtgaggccctgtctcaagaaaaaaaaaagaaaagaaaaaatttaaaaaagagaaatatccacagctttggaacaatgacctgaaacaatgatctattagagattttaattaaaaaaaattattttagtcaaaattgtgacatggctcaaataatctagtgctgcaaatacaattgaacttgttggatttgaagagacaggtctaacagccatgattgggcctggagtgtcaggtaagcaagttcacatgaaggcctagagatgtgactttatattctttagtcccttgaccagtttgaataagagaaatatggaggtaactacaaagaatcaaatccatattaagttgagtgcttgctctgtaccagacacttcatgtatatgtcatcctattgaattctcccaccctcaacactgagaaataggtcttctcattttacactgagaaatggctctgcgaggggaagagatttaatcagagttactcaatggtaccatcctactgctcattggatcccacttactctgtgcattggaaagagcgcaaagtgaaagcttttgacggaagcttataatgatcttcataaatgattgcattattgctcttcttattaataaattatagtcttgtgatttttattaagatttgtttattctctaagttgggtgtaatttattctttcatatttgttaattcatcaaaaactcattttacatctataatgtgccagatgcagggggtatagcagtgaacatgacaaagtttctgccgcctcgaagcttactttctgatgggggacgccaacagtgaatggacaagaaaataagatgactatagattgtgataagtgctaagaagaaaaataatcacagagaaactgggttgaatgggggtatggaagccaccttaggcaagatttccagagcagctctctagggagatggcatttaagcagaaacctgaagggtgtgaaggggaagacaggtgaagatgtagtggcagagaagaggttatgtgcaaaagtgccagggtgggaagaaacttaatgtgcctaaaattctggtacagatagccagagaaagaccaaggtcattgtaattctcatccaggtcattaatgcctcatgggttttggtaccatatgccctagatttcccaggacagtcacaaatattccattcagttattgttgtggatacttgttcttgtgacatcatgaatctaatttttaattcagaaatatgagtccaggctcactcctgtcatcccagcactttgggaggctgaggtgggaggatcgtttgagcctgggagttaaggaccagcctgggcagcatagggagaccccattgctacaaaaaattaaaaaatttagccaggcatggtggcgtgtgcctatggtctcagctacttgggagcctggaaggtcaagactgcaatgtgctgtgatcacaccattgcactccagcctgggtgacagggcaagaccctgtcaaaaaaaatatatatatatatgactgtgttttgttttggaaaatgtggttgccacataatgggtcactgcttgaaaacattgcgctgaactatactatcttataaagaattgtatcagtcccaccaaccccatcaatcagtcatttggatgacactgtgataggtgaaaaactgttcacatggcagcagccctaattaggcaacactatcctgcagcctctcctatcctcaaggtgtggatctgaacacctttttgaagcactgtgaaattgttttccacaacagccacaccattttagcatcccaccagcaatgtatgagagatccaattcctccacatcgtcaagatttactactgtctgtcttttttttactattgccaggctgctgggtgtgaaatgatatctcattgtggttttaattttcatttccttcatgactaatgatattgatgatcttttcataaacttactagccatttgtatatcttctttggataaatgtctattcaaatctattacccatttttaatcagtttgtctttttattgttgagttctaagagtttttttacatattctgggtatgagtcccttatatattatttgcagacttttttcccattcagtgagttgtcctattcactgtcttggtggtacccttggaagtacaaaagtttttcattttgatgatgtccaatttattaattttttcttttttatgcttttgatgtcatatctaggcaaccatcacctaatccaaggtcatcaagatttactcctatgttttcttctaagagttttatagttttagctcttacatttaggtagatgatctgttttgagttaatttttatatatggtgtgaggtaggggtccaactttattctcttgcatgtggatatctggttgtcccaacatcgtttgttgaaaagactactttttctccatgaaattatcttagatgcccacagcctttgaattcagccagtaggggactaacttctcccatgtagaagatgctgaatgtttggggatccagaaatggaaataatcattaaagaggttaacctagaagaaatagaaaccataggctttggttgctattctgtatttgtaaagatgctgtttgagctaatgagtgacatatagatttttatatatttataaagtaaactataacttaaatagtgagtgcagtgtttagtaactgctggtttagtgaccaacaacagtctatacattggatttgtttactcccaaaggtttttgctttttaaaaatgattttataagcatcagccttgctgctggacacaggtctgttgagccagctgaggaggtgagtggtatggaaagcagggggagttgtaacagagggtgctctttgacctctactcttttatcagttcattcctttcttcccctaaagggaggtaggcatctggatgacctcaactagaatttgaaggattctgggattgtccactggtttgctgcctgccactccctttcccattaacacaaaggaggggagcagcaggccagcctacctcccggggatgaaaggagctctctctggactggtaataccttaataggctggtcagagaatttttctaaggctatggagaattattttaaggcatgagccttcatttttagtttaactgctgtttaataatgccaggaaaacatttttctgtgttacgagttgattttatggataggaataaaacaagactcacaaatgacaagatgtcttctaagtaagggatcatcagttgcaagaaactttttcaaagaagtacagttgagaagattacaaggtgacaagaaaaccttttggaactcaattacagggagtgtggctggtctcttaggcactgcacagtatcacgcagctattctttctctaattatttctcttggaagtgtccctgtgcatcacagggattcacgtctctgcttctctctggacaatacaggcttttattttctctggctgcttaactcaaggattcattttgcacatggccaccctcccaaaaatccacctcagtcccctgagtacaatccgtcttggtcctacagtaccaactgaatcaatcttttgagtcttaattccaaattcccaggaaagagaatcgaattgctctatcatgggtcagaatgtctaccaggtccaaacagctgtagcctggagggtgggacaatgtttcaaagggctgcccctttaaagaagattccccacccctaataaagggggaatagactgagagagaataaatggcaactttactacagaaggtggagtagaagagaaggaggcaaatgatttcttgatgcacagaaaaggacagtgatgagaaatactgagttgaggacaagaaaaggtaagtaaagggatactaaaagggcttacattaaaaatattggtgatatggccaggcacggtggctcacttctgtaaccctagcactttgggaggccaaggtgggtggatcacctgaggtcaggagttcaagaccagcctggccaacatggtgaaaccccatctctactaaaatacaaaaattagccgggcatgatggcgggtgcctgtaatcccagctactcaagaggctgagacgggagaatcgtttgaacccaggaaacagtggttgcagtgagctgagatcgcaccactgcactctagcctgggtggctgagtgattctccatctcaaaaaataaaaattggtgatatgatatatcatggagttttcacttctcataagagactgtgccgaaatgtctccagacagtgctaggcaatggctggtggccatagccttggaaggccagttgggcattaagtgtttgcccactggggtgccagtgctactattaagggttttttatcccctgctggtctggtgtcaggggtgatgggttagaggggcgcagatggaaatgaggctgatattggcaggcactggggaggtggcttgatggtactcacaggaggcttcctggggctggcacagtggccaaggtagtggaggtggggatgagggacagctgttatttaccaactggtaaagaaatagttccatattttaactggtagagatactggtgcatacctgctgaacatcaaccatggcaacgagtgaaaaggtttcacgagtgaaccgttggatgatttagtgagtgtagctatctaacatattttgaaaatgaattttcctaaggctagatttaaaacttgcttaaggctccttattgcctgcatgatgagagtcaaactcccacaagatgttctccacggtctattatgatcttctccctggcttctcttccagcctgatgtccctccctgtcttaacatcctccagccacatcacacaccttgcagttccctgaatctggcatcctattttgtgtttcctcatccctgtgtgtatcattttggttgcctgaaatgacccctcctttctccacttatgcagtccttcacttccttcaatatcaatgcaagtgccacctctccctgaagccttatctgacagctcaagactatcttgtcctcctttctctatgcatctgggctaccatgcacgttcctcccttctggagtcattgcatcgtgttgcatttgttgacttacccatgtttccatctggtttgaatttcatgtgtgtgtccctgtgcctagcaccttgtcatgggcatagtaagtgctttggatattattctttatatttcaaattatttggaaggagcaaggtgtggaataggggtgagatttctatagaactcattttatacatacttcgtgaagataaaaacccaaaaatattattctcagctggcattgagaggcaggattcagaatcttcttttttaagagaatatttgaatggcaataatgactgattattgctgtgttcttagacaccaaatttgatttgacttcttccttatacttctctactggcctagatggaaaatacagccattgaggacataatgtttcctactggaatatggccatggcccttacaatgaatgagacattccttttgaatgtttgtgcttaaggtattttgactgtattataagaaaaatcatgatttgcatccctttcaatgtaagaaatgtggtcttttaagcaacttttgaaaatctgttgaagtgtttataagagggaagtgaagtccagatgtctgcagagattgtaaggcagcatctgccagctctaactaaatttgtctttcctggcctagaagagttttacccaaacatacagaagtagggcttcgagggaagacccctggagaaagtgacttttgaaggctgaagagcggtttggcagggaggtggaaaaagaatggggaaggagggaaagacagggcaggaacagcttatgcagaggctcaggggcttaaaatagcagggtcccttgaagcaagaataagtagctcaatgttaccagaatgacagatgagagtgaggagggtacggtgggagatgaagctggaataagtgggctggagctagatagctaagggatttaccgctcattccacaagttatggagaccagtgagttcatttaaacaaggcaagagaaggccaatttacattttaggaagatcattgcaggagtatttcactttgtttttattaaccttttcttctgattcctttctcctcttttccttcaatgccagacttctcagaagagggagcgtggcattgtgcatggggattggggtcccatgggattgaacactgcatgggctctgtctctaaccagacatgtgactttgggcatggcagttaccttttctgggcctcggtttcctcatttataaatccctaagatccttccaaaatctcttctaagttaaagtcatgaggttcttagttgtctccatttactgcccccgttttctttatctctcattcacttttcaacatagtgaactggtttctacttccgccagccactggagttctctggagcgacttcagtgacctccattgctaggtggagccacatcgtgcttaacctcttcacagcactgggtcagctgatcaccttctcctcagtgcctatccttttctttcctcatcattgtggtcccctggttttctcttacctcccctgccctttgcctcctctccctaggcctacctgatacatacaggggccggtcagtgtcactgatgacattttcttgccaaaaatgcatggcgtcaatctaataatgaggaaacagaccaatgcaaattgagggacattctacaatacaactggtctggacttggcaaaaaatgttattcttgtaaaagactaaaacagattgagggaatgtccaggttaaaggagactagaattatagaactaaatgcaatgtgtgactttggattgggtggagaggggttgctatatataacagtattgggacaattggtgaaatttgaatgtgggactatatatgaggtaacagctttgtgtcactgttaaatattctgaatttgattgtagcaatgcaggtatataagagaatgtacttatcttagaagatgtgtgctgaaatacttaggagtgaagaatcatgatggctgcagtttactctcaaatggttcagtaacgatgacagcagcagcgacaacaataataatgcatatgttttctttttgtttttgtttttttaagatggagtctcactctgttacccaggttggagtgcagtggcgcgatctcggctcactgcaacctctgcctcccgggttcaagcgattcttctgcctcagccttctgagtagctgggattataggcatgcgccaccgtgcctggctaatttttgtatttttagtagagtcagggtttcatcattttggccaggctggtcttgaactcctgaccttaataatgcatgtgttttatgtgtgtatgcattgtcttcttcaaggcatcttttctctccttttctcttcatgccatgctcttttcctaagacctcttacccactgcctcttccctgcttccatccttgcctttcccttctattctaaacacagcagccagagttatctggttacaataagtaattgcagtctttgctgtataaggttgtgcggttgaacaggtcgtgtcaattctctgccttgaaccctcagaggaaaagccagagtccttgttatggcttctgagtccctacttggggatttggccccttttacctctgcgatccagtctgttttccctacattccttgatccactccagccacactggccttctagctgctgcttgaatacccaggtgctcttctgccgcagggcctttgtactcttttgcactctttctgcctggatccttgtcccctcagacattcacatgacattactcacttcccttaggtgcctgatcagtgttaccttaactgattactctatttaaaattcaaactcttctctaacacattccttattgcacatccttgtttttttttccttagtatttcttttgatccatcttggctctttaaaatataagctgtatttgggcagggctgtttcattcactgctctgcctacagttctcataatggagcctggcatgtagaaggtgcttaagaagtgtttgttgaatgaacaaatgaaagacttgtgcatgacttttatttgtttttggatgatacccttagaatttctgcttagaataggacttcttttttgtaccccctttgacaggctatgaagcctatagacaccatctcagaataataggcttgtttgttctgttttacacttttattgcagtgtaatacagatacagaaaagtacatatatcatagtgtacagctggatcaattctcacaaacccaacacacctgtaaccttgctcacatcaaaaaatcaataccatccataccacagacagcacctcatgcccttttccagtgacaatccccactgcaaaggtgacctccatcctcacttttaagagcatagcttagttttgcttaaggtacttttaaaaggaatggtacagtttgcattcttttatgtctagctcctttcagtcaatactatgttgatgagattcatttgtgtttctacatgcttattttcagttctgtattttttgttgtgtggaaatactggagtttatctgttctactgtttatgggcctttggatggtttgcagtttcctttggctactcgtacaagcattctagcacaagtgaacatatatgcagttccacctaggagtggtattgttaggtcacggggtgcacatatggtacttgctagatactgtcaaatggttttccaaagtggttgcatctggccagatgcggtggctcactcctgtaatcccagcactttgggaggccaaggtgggcagatcacatgagaccaggagtttgagaccaaagtggttgtgtcgatttatacttccaccatcacagaatagtgttttctcatgtataaagtaaaatatatacatatattctataggaaattcttttgaaatatggttataaaaatagttttaatatgtaggtatatgttatatgtgcttctttattaacacatacaattaaaagttttagtagttcttataattactatgatttaaaagtagggatgaatatacctgatgtttgagatatctgcaacaaatgtaatgtgatatgaaaattctgtgttttaccagtcacaaggtcgcaggtgctgctaacacttctatggtttgttgattaccttttgaatgataggaaatcttagtgtgttacaagttagtgaaaatgaaggtataatttttaatctaagttcatcaacctcctgaaatctataaaagggtacatggacccccaggttaagaaacccttaaggaaaatgacttacaacaaagatttcttgagtgcctcctgtgtgtcataccctgtgtgaggcgctggggacccagcagcacacagcacacagcacacatctcctctcaatgaacttgcagtcacgagggcaggagtccacatatgcacagccagatatggttagttacccaaagtgtgtgagagcctcaggacatactcctagcccattcatgggaggcggttggtggttagggaaggctttctggaagaaggggcatcattagatttaggctgtatacctgtcactctggctacagtgtggataatggattggaggaaacaagtctgcaagcacttgaagtaatccaggtgtgaagtaattgtggtagaatgcaaagagaactatgaatacgttctggagactcttgattcctggtgatggattggatatgggagagggcattgggagtagggtagaaagaaggcaggtaggtgtaacgtagtggtcaagtttctgacttagtcagctggttgaatggtgatgaccattcactgaaacagaatgaggagcagcttcagggtcaggggagatgagttcagctttgaacatatttagattgaggtgtctgtgagacatccaagaggtggttatacatttatatgggcccttgctcaggagagagctgtgagagtttcagtgtatgtgtaggagtgggtgagatacccagagaaggtagggaggaaagaaaagatcccagggtcaggactttgagaaagatcaactttttagaaaccagcagataaaggggtacttatgaaagatgggaatggtcacaggggtaggaggcaaaccagggaagtagaatgcccttgaaaccaagaacagagagagtgtcaagaagatgctcagcagactcagcagagtagaagaaggtgagtctggaaaacggcccagtggatttagcaataagaggtcattgatgaattgcttttactacataaacactgggaatgatgatttttctctggattgtactttcatctgggttttaagctttctgttatagcaatacgaatgtccaagggtcatttcctttcaggtttacttttcttcttacatctgctttatatattttcctcatgctctagtgagttttatgctgcagtggtagtaggcagtcctttcagcttaatgacttctatctctagcagactctagctctttttttttttcttgggacaataagagatattgttacagatgttgcttcttggtaaaaagacttgcaggcctatttttctgcagagtagatatgaacacattcactttgactggccctgtttgtgtatgtgaggggttggcctactgataatgactttgcaggtcatctttcttgccttgagtgaaattcagtttctagtccatatgataaaaatgtaatagaagagatataaattctataaatttataattattttcttcccagaatgtcaacaacttggatttttttataatctatgggagaaaaatgagaagctacttaagttaaacaaacgtgttcagtgcttactctgtaaatgacagtgcaggccacacgatcacagcgatccaggcaggaaccactgagtgcctggatactccttccctcctcattcttattgtccagagagccccaagtgcagctgatcttggcctctctatcttactgcttctgccctggtccacatccctggttttgtgtggatggttacaatagagtactaactggcctcctggctttgatggttactcccctagcccatcctctgctcaagaacctggtgaacttaaacaaaaaaattcagatttaatgagcccactcctaaggattctgattcagtaggtataggtgtgaggccccaaaatctgcatttaaaaagttgccatagaaatatatatataggtgtatataaataagtacacacgcacacacacacacacttccttgctctttctgttaagattactaagaaagcagtgacacatcagcaccagaaacatgactagcaccaagaattcagtttctaaagactgttctccacaaaaaagaacagaactccttggagaaaaagctgattctaggcctggggcagtgaaagcacaagatacatctggaatatcttcttgtgctagaaaatatagcagtgcttaaagaataaggggagatattaaaatgacatgagagccagcttgaagggacttccattggcgacatctgggataatttgagcatgaattataatctgtagaataaaataaaaatccttgcatccatagtgatataaataactcaatggggagaaggcaaagctcttccttgtatagaaagccaagtattaaatatagctggaatgatggagttagaaaaccaatggatgctataactagtgatgaagttttgttgagaaacgtgattttacattgtcctccaccaccagatagttaatatttacaaaggacaaacaataagtacagtggagaaacctggcaacccaccataactaaattcaaattaacattcataacaatgggacaaaccacaccattaaaagaaaaaaagattcctcaagtggttttagtctccagaatttctgctctatgctagcactggaattagtgttctgtggcacagatctgatctgtctctgccttgcttaaaaactccggccaactctattgcttctggaatgcgaccctacccccacctttttgccattatctcttgccacagctctgtttccccgactttcctacctttggtcccatcacccatactccttgcagtaagtcaaagggtatatgtgtctccatgttactgcccacagccttgctgctgaaagtgccttccaggtctctggaatctgaatttgtggcagattcatataagccaagagacaactacagtgtcaccatctctgtgaagccctccctgatttcatgggggcagaactaatgtctgtttcctccttgccactgtagcattttctccgtctcttaaacacgtctcaattctgctatgactttccatttgtgtgtctctccaccccagttatgcaggcgactggcccctctgtgtcccggaggctctttatgtggtggaaaaagctagggcttcagtgccagtcacacctaggtttgaatctgattctaccacttcttagttgttacacagccagcctcagcttcttcctctagacacactggtagattgttattgagaattcaattcagtaaagcatataaggagctttgcaaagtgagttgaagaatgacataaaagagaaagaaacctcactctaggccctgagtaagttttttcacacgtaagtcctcactgaatttcatcattgataggtctttggaaactgtgactttaaacaaaacaatgtacaacaaaccaattttaccatcagccgattgatataaagagttaaattcctacgcatatttctggccacaggaaaatcactaacctaactaaagaccaaaatgcttatcatattaaacattaaagtaaatgggagctatctagatgtttaagaaaagttaataaaaactagtaagataatgatttacttgtttattcagttcagggtcccgggtggctggagcctatccccgcagctcagggtacaaggtgggaaccagccctggacaggacgcagtcacgtcgcagggtgcacgcacatacacagttgcactcatgtagcactcatggagacacaccagttcactgaacatgcacatctttggaatgtgggaggaaagcagagcacctggagaaaaccctcgcagacgtggggagatcgtgcgaactccaaatgacagtggccctggccaggaattgatattttttctcatcaatgttgtaacaagacaatgttattcaaggacctgctgtatatatctattattttcaaagacgtattttatatatatgcatttttccctgtaatcctgaagagaattcagaggtatagttacatggctagtaaccaacagacccaactttgaacctatttctgactccaaagccatgttctttctattacatgggaactcataaaccaggagagacagagccaaaattaccttaaataagaagcccatagtgaaaaatgttaagctagagttgtagtctctaaactttttttgattgtatacctctcttggtaaaatactcttgtgcaactcccactataggaatatttgtttttttatatatttatgttatatacttgtattattgtgctaacattatattataaaacacatatgacatttacattaaatttatatgtgaatgcaatttacatataaatttcttactatactcccccaaatcatcttgcacatatctttgaaaacccctgaactagagaatagaggaaggaaggtaaatttgactagtggggttttggaagaacccattctggaagagatggcatttgggtggcctctaggaggatgttaggaagttagctggcacactgggtgggggaaagcattgcaggttgaggtcacagttaggatgaagacaatgcattggacaattctgggcatttacattgaacaatggtagttgggccagaggagagttgtggggggtggggggaatctagaaaataataatgtagcacacttagaaatgcagctgtgagacaggcggccttctgagctaaagagattgctttatgttagcagtcttttgtggggaaaggaaggacccataatggtggtagcctagaagaaaacaagagctggctgagtgcctaaggggccagaggaagggatgtaaacccatgggaatgtccttgggtggcaaagtgaccccgagggataaatttgcaggaacatgtaggtgatttcacatttggactggataaaaatccaaatgcggaggtgagccatggaagctttgaaagatgttagtgactgtgactggatctggattttagacatacggacttataaaaaagtagcatggacaggggagtggggtgtgcagagtcagggaggccagtgtgaaggaatgacctctggaacgcagagcagggggagcaggagggagacagtggagaggcaaagggggcattcatgggatgaggaagtgggagagggaggagcaaatgcattagatgactaggaagttgtgggtcagttaggggagagagggaccgaggaggaggattgggttctggggtgggaggatgggggcctatttcagacatgctgagtttgaggtgcctattgaaaatttaactatggacattagaagtgcacagaagagaccttgcctattcaggtgtcagtcaccactgtattaggtgcaactagaaggatgggaatgcatgtgtataacacaacacacacacgtacacacacacacacacacacacacacacacacacacacacacacacacacacacacaccctgccatgcaggccttcccagtgagggagtgagggaaagaaggcattgtggggtgcggagaagagggcctgcctgcctgcacactggtttgggggagtctttacaagagaagggatgctggaggcgagtctttaaggcaggaaggattctccgggtatgaggtctaggaagactgtcctgctattgactccagggtagatgagaaggaccaggtttggtgaagcagagaggtattacagaacactgaattcagtttagaagtggttaatcttgggacagactattcttttaagggtaacttcccaaggagggaacaggttggcagtcttgactgcaggtctgatcttcaggaaggtggttggatggagatccagatgggatagtgccttctatgaaaggtagccagatggataaaggtgagactcatgtcacagacactgactgagtgcctgccaggagatactgatggaggttaacatatgggtgaggtgaaatgcatgtgaaatgaaaaggcacaagaccttaagacaggccaagtctggtggtcaatatctgtaatctcagcactttggaaggctgagagggtaggatcgctcaagcccaagagttcgagatgagcctgggtaacatggcaagactccgcctctacaaaaaaataaaaataaaattagccaggtgtggtggtgcacctctgtggtcacagctgcttgggaggctgaggagagagtattgcttgagcccaggaaattgtggctgcagtgaaccatattcactccaccacactccagcctgggtgacagagcaagaccctatctcaaaaataaaaagagcttaagataaaaccatggggtacatccttccctttaactactgaggagaggagaagaagcatgaaggggcctgagcaggagcagagtagccaggaagaattggagaggtttaggattgtaaaccaagggaggagcaaaattgtaaaccaaattgtaagccaagggaggagcgaaagactctgcatgtgttttgctggagctggtggtggaggaagtggaggtggggtcaactgtggagctgtgcaaaaagatggaccaggattgagactcaaaagaggttaagggaagaacaatttcattccaatggtatggggcagaatccaaattgctagaacaatgagtaagaatgaaaatgtggaggcaatgggaaagtgtagcctaattagggcaaggcatttcctggtatctggaagatttaagagttgtcttgctaataggcacctattctgggagattcaacatgcccaagatgccatctgtttcagtagggaatactgaatgaaggtgcaggttgaccatcgactgtgtctctttttctcaaaatgatccttaatcaagaggacatatctgctttgatggagcaacaagtcagaggtttgaaaatctatttattgttttccttgggtacaggcttgtgatttcgtttgtttttatggtggttaattattcctgaaatttcaagatatatacaacattctgtttaagggctttgtcaaaaataaaaatataaagaagagagaaaaagaaaagagtgttgttgttgttactaatccttatagtatgtcacactgcgaagactgatttataggtgcaaattttacagaattcaggacttagtttttttctgagttatagcatctttttttctctttaagcgacttttttgttttatagctagaaaacgattgatctgtttataggtatttaattccatacgtgtcctagtttcatctaattctcctttgaatctcaaaagctaattcagcagctagctttttctttctgggtaccacacaaaaataaaaaatcaaatttccagcaataaatcaatggaaatgttagagcagtactgtgccacgagtgatcagtgattggccatagatgccacatcaaggaagcagtcactcagtagatatcccaggagtgttttttactgaatgtcaattactgaatgtctaacttactttctctggcactgtatgcacttcaaagagactgcagtatgagcgctgtgtattttctacagcctgtgctcattcaaatcttcatttgaccttttcccttgtgttcacaggaatcttaactataggattttaaaagtgattttattaaatatcaaggagatacataacattttggtaaatatgtaaagtgtaagtaataattaaagatttttagaacttcaccaaatgtcaccactgtgttggtgggtaaaatgctacacttgtttttctaattagaacaccctatgcagtgacctgagagtccaagggcttcatgttttcagagcgggtcacttcaccttttcagccatgacagaagcaaatctagccgaggataccctttcttttcatgccaagtgtgctttctgcataataaggtaaaaggtctgctagactgatgttcaggtggtggcaacatactactataggacaagatcctgaaattcaaaatagtgggagttaataatgggacattttgtgaaatgactaaaaacaaactcattaacttatatattctttggtaaccttacttatcactaggctaggagaaaattagtatgcatgtctgaaacccacataaagaatgaacttaattcttgcttaagactaaaatggcaataaaaagtggtaattgtaagggaaattggaactttaagtaaacttatttgaggctctttgttttattttatttgggccctaagcaaaaattactgtactaattagcatgattgatttcatcccatgttatttatccttaagatatgaaattatgaaaaaaactttgagatacatgtgaaaaaatgttaaacagttcttgtttctactagtatactcattttaatcttctttatttataactacattatacaaatttatctaggatttttactttatattaatacttggattacagaactgagtcattattacttatcctaattttgtgcttggttaaattttgttacaatttataggtttagaaactttcactttaaaatgtgcaaggtattccagtaattctggggaaaatgggttccttatagtgaagattattacaaaaattataatgggtaaaattgtttattaattctggcaagacaccaaaaagaaattatagtagttgacagaaaactcagaaaaaataaactgtaagagaacataggaaattatcaaaactatgattatatggtgtcaaagaaagactcaataaaactttatttccttttcatacgaaaagatttgccccagtacctttggtgggcataatttttatatgattcttagttgaagctataaactaaaaatcatgggtgttattaaaagctgtcttctaagatcctacctggattgggagaatatggaatctggttttggtttttcttcttcaggctaaagggccagagtatcttgtttgctgtcttcatcactggtccagcacaaggcctagtatagggaggacactcaacacatttttgttgacttgaattgactcagaggccagtgtttacatacattgtggctaccagaagaacccctggacttctttttattggggggcagggaacaggattgcactctgtagcctacactggagtgcagtggtaggatcatggctcactgcagattcaacctcctggactcaaatgatcctctcaccctagcctcctgagtagctgggactacaggtgcatgccacactctctgctaattttttatttttatttttgtagagacagggtcttgctttgttgcccaggctgggctcaaactcctggcatcaagcaatcctcccaccttggccttttaaaatgctgggattacaggtctgcgccactgtccctggccagaatccctggacttctaatttgtcagttcaatcttggttttatgtctaagccttcatatcgatggacatttagattgttgactattatgaacactgttgtagcacacatccttatgtatactttctagagtatatgcgtgtttctgtagcagatatttctagaagtagaatggccagggtcaaggaatgtgtatactttgtattgtgatagatgttgacaaattgcctttcaaaaagagatgtaccaatggacatgtaggaaaatgatattcctgacggcttcctctgctcttatatcacattagttttaactctcttaaagacagaaagaatgtggaaattttaaagttaagaaagtaaagcattcatgggtgaaaataataaacaatgtttcttcttttctgtttggtctctttcatggtaaatgcctacatttacacatgtgaagactcacagaaatagtctattaaaataataaacattatattcaaatataataatcttatattcaaatatcttgggcttgatcatttaatatgtgattgtttaattgctgtcataacataaatagggatttatcatactgtcttttctatagagttgtcctaccaataatatatattatcgatgcagagagaagataaaaccaacattttataatgtgtaccttattgattaataatatgtaattatatacttcatatatatgtgatttatattacctattattatgtactgggcacgctgagcattttgcatacattaccttatttaatgctcacaaaaaatttttgaggtagatactattattccctgtttactgaagaagaaactgaggcctggagtatttaagtaatttgccccaaaacatccagctagtagctgtcaaacaggagttaaacccaggcgtctctcaccccacaccccagctgcctaatttacgtaattgtctggcatattttagtcactcagttattgtcatctgatggtaagaatcagggatatttttcaaagaaaaataatgacatgaatttaacatgaactcccatcacggtatgtccatttgaggctttcagagaggtccctactgaaaaaactagccctcttctaagaatttctgcttgacactaggtccagatcaatttttttccttgatgtttgctgaaagcaatggcaacaattcctgtcacctgtttcttgaacaagggaagtactttggcacagagcagggccctgccacggtgagctccaggactatccatcgtgcactgtccacaatacccccttggcctggctgcccagcctgagggcccgatatttggcttttggatatggcccaggaagaactcaggtgacatgcagattgataatatttgactcctgggacgggactcaagctttagacctggaatggccaagctggaactctgccattccgatggcttcatagctacttactcaccagccagtctacagcattaggttgcttgctcctctgggaagccataaagagctggtgtgagcagttagcttattggcatcaccaccacagttttttggtgtttagagactttcagttcagggtaacagaacccaactcaaattggcctaaggaaacaaaggaatttagtggcttatgccactggaaagttctagattggtgctgacatcagagcctacagggactcagatgactgtcagtagtatcttagactctccctttctccatctcttggctgtgtttctctccggtcgttggcctcattctttccttctgctggccgatttttttgaacctatgggtataggcagtatgttgatgccaatggtcatgggtggcttctggtttccagcctctcagctcaagacctcagaggaaacagggagctttcctagcaacagattgtaaagttacagggaaggacactctggccttgcctgggtaatgtgaccattttagacatatgactgtagcccagaatgggtatcatggttgtccgatcagtgcaagaaattgtgattggcagtcctccccgagccacatgggatggggaagggccaatttttttaaaaaggggagaagagttattaccagaagaaagggaaagaaatgttgagcttactaaaacaatatgtatttcaaagtggtagttacaagaaagcctggaaaataataggatgttgagcttgacgcatcattcagagaacagatgagtccaggaaacaatagatccctgcttgttatctctttgaaagggatggttgccttcaccaatatctttttaggttgagaatcagatccatgttttatggtgacaaagacaatttacttgggcaaagggcagaatcatctgggcatgttaaatagcaaatatgaaacctgcatattggattactggtgtggaggacagggatcacttccttagtgtagttcctgagaaacacacggggatgtaaaggagcttgggcatgagcttatcttggaggactctaatgggagtatagataaaatggaagcttctgaacagaagattccctttgaatactgagcagaaggttcacaaggaactttagttattttatgcaaagcacaagggaacagagaggattaaattagagcttctgcttccagaaaaagaaaaaaaaataggataagtttaaaggaagagaagcttacaaaaggaaggacaaatgctccgcagcacacagtaataccccgtcccctcaaccttccatcccccatatccttatcaaactttagacagatttttaaaaatcactgaagttattttgtgggcctatatttaaaatttatttttcagtttagacagaacatgttattccatgttggcacacagtagcctaaaagttgtcttggttgaccgtgcaaggtttgttatgctgaatatatagtgccatttattgttaacttctggctaataaatgtcttcaatttgctttctgaaaactgaggcagttagagggtatcaaaaagaggatgaaacttttatcatccagtttcaagaaataagggtgataggcctttgggtttcataatgataactggaatcctttaagggtttgcattttgtgtatttaactattttgaaggtaaacttcagcagcctctatttgtaacttaggcttccaaaactttcttccttctttcccaccttaaggatgagtgcactttagggcatcattttcagcatgtctagcgtgccagtgtttttcattacactgtgtttaaattacatgctctacttaggtttgttgggaacctcacagaatctcagttctgctgttttttaaaagttactttttttccaccattataatacctatatttactcattaaacaaaattttaaaaataagacaagaaaggaaaaaattattcatagttgaaccccaaatatctgttcacatttttgtgaacttcttaattgaaatataacacatatataaaaaagtataaaaattatgtgtttatgatgaaatttagcaaggttaatatacccatataactactacccagatcaagaaatagaacattaatgcagcctggaacctctcacctaccacttcccagtcattatgccctcttgaagataaccactattctgactcctcttatgtagatatgttttgcctgatattgaactttataaaaattgaataataaaatatgttctcttttgtgtggggctgaattattcaacatttgtcaatgaaattcatgcatgttgtagtagatagcattcgttcattctttttcattgctgtatagtattctactgtgtgaatataatttattctgtacttgctcttagccaaaaggccaagaagtgataaatataatttattgtgttcactattggacatttgggttgttttcactttgagtctactataaataatgcttctttttaaaccttttttttgagacagagtcttactttgtcacccaggctggagtgcagtggcacgatcacggcttactgcaacctctgcctcccaggttcaagcgattctcctgcctcagcctcccaagtagctggtgccacaggcatccgccaccacacccagctaatttttggatttttagtagaggcggggtttcaccatgttggccaggctggtctcgaactccgtgagtcacggtgcccggctacattcttatacatgtcttttgacacctggatcatagggcatgcacatgtttagccttaataggtatattaccaaatggttttaccaatttatataccactaatgtatgagagttctagtttctccacattcttgccaagacttggtattgaatgtctttttcagttttaattatcctggtgtggagtaccacattgtgtttttaattttattttctctgatcatcaataacattgagcactagtgtagtcacaatgatgttcctctaaagatatatcgatgtcctgatccctggagcctgtgaatatgtgacattacatggcaaaagggactttatcaatgtaattaagttaaggatcttaaaatgaggagcttatcctggattatcccagtgggctcaatgtaatcataaaggtccttataagtgagagtgacagggagtcagagaaggagatgccatgatggaagtagtgatgctatgaggaaggctcgactgaccattgctggctttgaagatgaaagggacctgctagccaagaaatgtgggcagcctctagaaggtagaaaaagcagaggaacagagtctcccagtctccctagggcccccagtaagaatgcagtcctgagtttttttttttttttttttgagagactgggtctgattctgtggctcaaactggagtgcagtggtacagtcatagctcactgcagcctcgaactccaggcctcaagctcaagtgattctctggcctcagcctcccgagtagttgggactacaggtgcacatcaccatgtctggctaattaaaaaaatttttttggctgggcgcgatggctcacacctgtaatcccagcactttgggagaccaaggcgggtggatcacgaggtcaggagttcgagaccagcctgaccaacatggtgactccctgtctctactaaaaatagaaaaattagccgggtgtggcagcctgcacctgtagtcccagttactcgggaggctgaggcaggagaattgcttgaacccaggaggcggaggttgcagtgagtcgagatcacaccactgcattccagtctgggagacagagcgagactccgtctcaaaaaaaaaaattttttttttttttagagacagaatcttgctacgttacccaagctggcctcaaactcctggcctcaagcaatcctcctgcctcagcctcttgagttagctgcgattacaggtgggagccactgcacctgtcttgaaaatctgaccactagtcagccttgaaaatcttgattttcgttcattgagacacattttggacacctgactttcagaactgtaagttagtacatttgtgttgtttgaagccactaagttcatggtaatttcctattatggcagcaataggaaactagtacaagcaccttttcatgtgcttagtgaccattttgataccctcttttgtgaagtgcctcttcaggtctttttgaccatttgaaataactgggttgcctgtctttttcttattgatatatatgagttatttatatatactggatatgagtactttgtcaattctatatttcaaatatcttctcccattctgtggcttgcatttgtattctttgatgatcagacattctttatttagtgaagtccaatttatcaatctttatcaatcttttactttatgattagtgctgtctgggtcctgttaatgaaatatttccccaattcagggttatgtaaagattttcctatgtaatcttctcaaaacggcactgtccagtagaactttctgaagtgcagaaatgttctatgtttgtactgtccagtggtagcccactagtcacatttggctactggccacttaaaatgtggttagtgaaagctaaattttaaattttattagattttaattaattcaaaattaaatgtagttagtcacatgtagctagtggttaccacaatggataccacagttccagaaactttattgatttacctttaaaatttaggtctgtgatccaatggaaatgattttatgagatggtcatgattagcaatttgttttttaaatacagatatacagttaacccagatctattattgaaaagatcattttttaacccattgaactagtggcaaccttgtcataaatcaggcagccctaataagtctgtttctggattccattctgatccattagtcttcatccttgcactgacgccacgctgttttaattactgcagtttgaactctgagaatataacctctctgactttgtggtacttcttcagagttgtcttgagtattctgcgtcctttgtatttctgtatcagttttagaattgatctgtcaatttccattaaaaacctgctgatattttgattgagattatattgattgtataaatcactttggagagaattgacatctttataatattgagtcttccaatccatgaaaatgatatatccctctactttgttctcttagtaatggtttataattttctggaggaagtcttatccatcttttgatgttcatctctacgtatttgatgggttttgatgctattgcagatggtatactttcaatgttcattttctaattatttttgctagtatatagaaatataattttttagttttttcgagacagggtttggctctgttactcagactggagtgcagtggtgtgatctcagctcactgcaccctccacctcccaggctcaagcgatcctcccacctcagcctctgagtagctgggactacaggtgcaggcaaccacgcctggctaatttttctatttttagtagagacggagtttcatcatgttgcccagggtggttctgcttaggtttttaacctcttaaccgctgttttctgcttggctaagaaagctcttccttcttgtatgtactggttaggaatcggcaaataccttaaggggaaattgtatgcagagggttggactttcctctctgccataccatttttaatttggatcttggccctcttccttaagtttaggctgccttggaagccctgaattctaagttttgtttctctcattcagtgagaatgccgtgagcgataggtggcagtttctgcttaccctctgggctctgcactgcaaattggtaaatgccccaaggaggcagagtgggtgaaatttagggcttactttaatgttcagggcattgctcttctgtcaggatccctgcccctaaaattcctcctgctttggtttgttcatcagtgtcttcaatcgactgtgctctttaattttatctagcttttatagaagttctcaatggaaaggttggtagaataaaattcactttgtccaacacagagtggatgtctaaatgttaacattttaatggatattcattctgtttcctttaatgtgcttatgtttttatgtctgtgagcatgctgtttatacaagtttgggttttggtcctgattttatattgtcatacacagcagtttcttgaaccatttctcttgtatttgggcagtagggtgtttcttttattttcctttttaaaaaaatctttttttaagtttatattttcctttttataaatgatgttctcaggagcatttttttctacaaaaagccttttttttgatttggggttattttcttaaaaggtaggatttctaatttatttttgttgtggttttctctgatactctgggtcattattcctggcatactgaaatttaacaataatgtggctttgtttgggtcttccatccattgatcttgccttttttgggcctttcaacctacaaactcctgagtctcagttctggaatgttttcttgccttcctttccattctctttgctctttcttcttcaaagctttttggtagttttgagacctcctggatctgtaattgtaatcctattttccttattattattgttttctattttctggtagatttttctattttgtcattcaaatcggttgaatttttatttttatattttatattttaaaatgctttttaaaaatttactgaatttttcttttttataccttcttgtttcaatatattgccatattttttcttttttctgagtatattaattatgtccctcccttatgtctccttccttttctctgtcacctcagcattccctttttctcctgtatatttgtattggtctttaacttttaggttcaaggctttcatcagatgttgggcaggctttggctctctttgtatttaagagcaagacccctgaaagcaaattgggagctctatatgaggggcagtgttgatgagtggtttcaccatagggtgttaaggtggtgcaccgcctttgcaatggaggatgctgtaatacaatgtcaggatggaggggcattttctcttgtgttggtcagtttccccagaaaggaacctccaatctcttgcctgggggtgaccgtggggtatgcagtatacctggtggcaagtgttccaggagtaaaatggagagaggttttatggttcacaaggccgccgactcacttaacttcctgtatgagctttcctcagctgggcagccccagagagtaaatctccagagttctgctgggtgagaggaggattctggtggactcactgttctttacacaagctctcaactagtcctcctactttcaccccctccctccactccagccttcaggatatgtatctgcaaggccctgagcctttccaggtttccggctgtgagctggctgcttctttctgacttcccccttcttcctcccaccctcgccctggtaggcttagatttcttagggttctaaaatcagtcaccacttactcatttgctttccagctcctttttttttttttttcttcaaggtttcttttgcatactttatcctttcttcttgttctctttgtctttgtgggcctgtgtcttttaaaataactccctatcttttcaatttggcaagaagcatagataaatgctttaaaactgaaagtcttgcattggattttgaatgccagtcaccgtaattttcatttctatgagttttatttgactttcacttttcttctgttctcgtatgcattattcttaccatgtgatatctacaccttcatctttttattgattttaaatagatttaaaatctttccagctgttctattgttttcaagtcctgaagggagaggggagtgggtggaaagaagggatgctaattgtcttgcttgctgtgtctcctgagtcttccttacagtgacttgttttctttgtccagtgtaatactatttctggtgggagtcctgtatgtcctggttgtggagacatccctacagagtaggttttgccttgcttctgatggcccagaatgtgctcttatagtttctcttatttctggacctctatacgtgtggtttcagaaatgttctattttctcatctttgcttcactgtctcttactaatctctcagatctctgtttagaagtgattttctctgggacggttttcccagtcccccattccctgtattgtcccctagtatattatacttcctccaacgtagtacttattaccctgtagtatatcatccatttgtttgtctctctcttccttgtgactgattctggaagacaggatcatgttatcttgttcactgttaaatatctagtgcctaccaaagtacctggcccaaaccaggtgtcagtaaatattttataaaagaatatgatgctatatcttgttttaagaggctttgcagggatgggttacagattggtctgagagcattgtttttttaatcccagttttgctacattccaggtgacactccttcatagagcaatgtagggtaatgcaggggtgctctgcaaacataaaatatgggtggttcataagttgcctttttgagctatagattttcttcctgttttcatcacttccacatatagtacataatggatcacacacttgaaaacaaaaaatagggatggagtgcttggcactcagcacacgacccagtattcttgtgtggctccctcttagacccagtgaagcagcctccattaggtggatgttttcaattccattttccatttgtgaaatgtgtgattatgaaacagctgtgtaacagtctgttgtgtctagcatgtcttcttttcaggtagtaggaaatgacaagttcatactagatgaataataatatgcatatctgataattaggcccacagtttacagtggctttgactggtatttcatgtagctatcttcaaaacttgagtttaggaatactgtccaaagaattttttttatagctaattgaatgagtaaccttggttttctggagtattttatggtaatactagaaagaatagtggtggtaactattataagatcatgggggaagtgctaaaatgagtcacttattttggaaatagcaataatattatttgctaatatttattgaatgctgactaaacgcatagtaactttattcatttaaggagcttttaaaggttttatagagtttttaaaagtcataaattcagacataaattagcaatggatgccaaatctgggggagagagaaaaactttaaaaactctaaaaactttacatgtaccaactcatttaaatctaaagaaaagttggatttataccaacacatcttcatcaccaagctagcatgtgaatgctcaggagagagcatgcagaatctgctcaaaatggagacattttaactatatcccaatgttaggctgtgctaaggtgatccaagagtgaagttcgaggttggacaaaattagatgtaattaatagttgaggaaacttccttccctccatatatatatatataaaatctttgtttacatataatatatatttatatatattttaatgattaagtgtaggtgagaaataagataacttgctctagatatcagcaggatcattatacacagcaggatcaagactccggctccgattctgggccattactctgatgcattaagaatgttagtaatttaaatagcctaacttccagtttttctcagtttccactattttgtagtcaaattgatcttggtcttagatttatttagtgtttgactcgatccatatttttaatcattgaaaattaatttttaactacttaagtaatacatgaataagttttctttttttttttttaattttagaacattccaaatgaagctttcatttcctgtcctggtctccctccatgctccccagatattcactactgctatgagtttggtatatatttttcagatctttatattcacgtactacccaagaacataacagagtattgctttatgcatgtgcttgatttctttacataaattcccctattgacagacttctaggttcttttgcttttcaaacagtgtttcagtgaatccttgcacacatgggagagtggccctctagggagatatctagaggtggacttggttagtcacaggtatgcccattttcagtttcaatatagcctagaattgcagtacctagaggcagcaggcttgcagagtacctgtttccctaccatctggccggtatatgacactatcaaattcaatttgttttgccaaatgtaattttatctgggttttctttcttatatgaagaagtaagtttctatctttcccttatacaaacaaaccttgacagagaatcactgcttttgtcctggaattcggaagatttcaaagatgggaggtgtacatgagatccattctctctccccattgctttgaagttgagggagcatttttttttttttttttttttttactagaaaaagaatctgggacagactgaaagatggaagttactctgtgtctgggaaatacaaacctcctgaatctagaagcatgaggcttagtatgatgaatggtgaccaataatgtttttattaatctgggaagtactgagtttggtaatcagtatctttgaggtttatgctagtgaagttaatcccaaggcatttgagaaactagatttcagcttctctgctttatggttttaattccactttattcttagtggtagtgcagccaaatgataataactctcatcattgttgagaaattgttttccatatggttatttcatctgagaatatgattttaaacagactaccaaagtcatagtactcccagtttgtggaacggacttgtttaatgttataaacttgaattttgcagttttgtgaaccaaaaaatatgataataaacaatacgctttgtttcttttttattaatgcttaactgaaaaaaaagcataaatgaaggtgcttatttttattaattggggaaataccagggattaaacaaagcttagtccttcagtgtttataatttctggtaagaaagttgaataaggtatttccccttttcagagcagcttactagttttatctgaggtatataatatgtgaatgtaattaaattatcaaatttggttgatcatttaaaaaatcacaaaggcataaaagtggacatttatgaatcacattgcaatttggtcaaaagtgattctttcactaacataaatcataaactctgtggatatagcttgactttaatttgtctgaattatgatatggaaatgtttaaaatggtcaaaaatagttgaggtacctatgctttaagtttaaaatataagtctatttaaacttattttggaatcatttcaaacttgtagaaaaatagcaagaatagtccacagatttcatccatttttagtattttgacacattttctttgttattctttctctttatagatacgcattagtattgcttttttttttggaatcacttgaaagtaggttgaatgcatcattcccttttacccttaatactaaaacatgtaattttaagaataaggatagtcacttgtataaccacagtatggttattaaattcaggaaatttaatgttgacacaatactgttatctgctctatattcttctttagtcagtaatgccaataattgcctttagggcaatttttttctggtataagatccagctcagataatgtattgcatttcattttcatgtctccttagtctcttttaatctggaaaagtgcctaagcctctctttatcttttaggacattgacattttagaagaacacaggccagttcttttactgaatgtccctcaagttgggtttatctgatgtttcctcatgatcagctttagggtatgcatgtttggctggagtacctcagaagtgatagtgtgtcctcctcagaacatcacggatgggaatgcatgatgtctatccactcattattggtgatgttcaatctgatcatggtaaaatcgatcattaaatgttatccattttctctatcatatagttactatttttttcttttctaattatagagtaatttgagtggaagtgctttttaagactccacataaatatcttactccccaagcgtctcccacctccagatttagtatccgttgctaatttatgtctgaatttgtgacttttaaaaactccattgttccttccatatttattagttgacattctgctataataaagtgcttcctgcccttatttattttgatgctcagattatccccagggccaataggaactccatttatctatttcctttgtccttctgacatgctttataaatttgtgtagcatcttattgctgtttggcatcatagctgttccaggtccattttgtactttcccttccctagcactggaatcaatttctccaagaaattctggttcttttagtgggactggtatttaagaactgtgatctgtgatcattgctgtgccagaatgtcattgttcttgaccttttcagcagatggagctggggaatatatatacctacacactcatatatatagctaaaaagatagagatacatttaaacatcttaagtttatactggtaaccccccaattccaacacagcttcccaccctacattcttccttggtttctcccatttattatttatgtctcttttcttccatagtgagaagtctggctcacaaaacataatacatttattcatttgatccatcctgcaatgtgcataaaatagtttcaggattgtatacccatcgagtatgaaaaacaaactgctaagaagagttcaagatttatttgcagttcttttatatttctttacactgagcatgaatagtcaaagttctatgttcagaagttacttggattagttctgtattttaaaaattcagcatggttatgttattcattttaaataaagttgggttcactggaatacagttaggtttacattcagttttaggcttctccctctattcttgttgatctaattgaatttttgaatgtttatagaactttaacatgattccaaaactccagactatacaaaataagatatactcagagaagtattccaagcttctttcattttattatcttttaagttagcaatctgcttttaaagaatattgagaatttaaaatcaaacacagtgtttggctaggtgcatttgtgtggtttttggatgggtaggtgggtagagatattactgtctgttctccaagtcatagaaaatatggagaatgaaaatcgtctttctccttctaccaggagcctaaaagggtgaatgtattcaaagtggttaaggtaaaaattgggtatgacattaatttcatcggaaaacagcttcagcaggcctggcagggtagggtgagggtttggaaaggctctggtgctttcagggcgtgacactagggggcaccttggctctgatgctgccttcaggctcccttctctgccagagcgaggctgggaagtgaggttcaagatctccagccctgaaggcctctccaaactccgttggttgttctgtgccatcttgtagggttttgacccaggggtggacagaagttgaaggacagggacattctcaggcctctggccttttccctcgttgaccttcttaacttcctgccctctagtcagcattttattttgtttaggttggcaaaagtggctgagttaagtaacctgtccaaggtcatcattcaacctccaagcagtccagttattttcaatatgccattttagaaaggttatagacagcggccatttatgctgtgtgcctgtctgcctgtaaaataagattaagtccatataatttcctaatacaaaacaaactggcacaaagtagacatagtgggaatattattagttacacgttatgaagttggaaaattcaaatgagagccatttaaagtaaatatagaattagcgagattagaccaagaggaaaaaagttgagctgataattaactcaacatctgatccccccaaagcaatcacaaataaattcattatccctattgctcgtgaaacctgggggcactccacttgtataaggaatttgaggtgcattaactttaaattgcacttgtctgcttcttgttgcttgtgtaggcatgtttgcattgcttacattaatgcttagtaattcagtggctaatgtgaaatccccctgctttaactttggggaagataaaattaaattgtgccttcatcaataaatacaagaataggttaaaggctgaacttgtttttaagaacatcacctatctcatcaggagtgactggttaaatactgttctgcctagggcagaatcaaacgcagtttggggaaatggggcagcaaaaggccatggtggccttttcagctttctttctatttggtatatgcatggtaggagatgccagattcctatttaacctcttctatttacaaaactgcttatgccaaaatttattcatgagtgcttccattaaagcttgtagtgaattttttccacctgggattgttggcatttgattagtgggagatggttaaatcacacatatgaatagttagctaatatttttgctttcagtgtttgtttccatttttaaaatttttcctctcttttgcctacattagaatttttttttctttatttcccactttctcgtaataatatattttctggatatcttcctttgagtggaaaactacctgaattttaaatttaagtgatcgtagaagttttagaagcagtaaatatttattatattcagcctctaacttattgtgtataatttaacacacataagcagatctctagaaattacttacaagggtatttttaagaagagaaatgctgatcttatatttttagtatggattgacataattttaaatcttcttaaacaatggctaaaacttgttatgaattatctatatctataattttagcatttaattatatatctcctcttttgaactgttctctggttgtttaccctcttttccctacaaacttaagggcaaacaaattttatgcattcttttatttttatttttattttttggagatggagtctcgcttagtcgcccaggttggagtgcagtggcacgatctcggctcactgcaagctccgcctgccgggttcacgccattctcctgcctcagcctccctagtaggtgggactacaggcacccgccctatgtccggctaagttttctgtatttttagtagagatggggtttcactgtgttagccaggatggtctcgatctcctgacctcgtgatccaccagtctcggcctcccaaagtgctgggattacaggcgtcatgcattctttttagtttagtccctatggtaccatctataccattataaaataggtacttaataaatagtcaataaatactttaaccatttcttatctacatacaatctactttcttttttattttactttttattttgaagcaattttagacttagaaaagttccaagatgtgtaagaagaataccaatatacctttcacccagattcctcaaatgttaagtattttgccacatttgctttaatattctctctcttattctctctcccttctttccacctcctcctctcacactttccttcctctctctattcttttccttcatctatccacatgtatatgtatgtagatacatatttttttcttgagccacttgagagtaagttgcagaccagacaccttgtgtagttactaaaaacaaggacttcttttgtgtaaccacagtatagctttcaaaatcaataaaataatatttaaacaatagctgatgtatagatctgattaatattttggcaattgtcccaataatgtccttcagagcaaaagaaaatcccagatcacgtgttaaacatatcaagtctgttttgtcttctttgatctagaacatttccttagtctttctttgtctttcataaccttgatacttctgaagaatacaaggcagttattttatagaatgaccgtcagtttgggtttgtccagtgttttcttacaattttgtttatataattttggcagaagtatcacagaaatgatgtattcttcttagtacataatatcaggaggcacatgatattaatttgtcctattactggtaatgttaactttggtcacttggtttaggggatctgccagatttctctatggcaaagttactatttttttttcctttgtaattaacatatatcttgtggaaatacagtttgagtctgtgtaaatatctgtttctaatcaaactttcacacaggagttttagcatcaactgatgattcatggcatagtaaattattattatgattgccaaattagattctgttattttgaatatatatgtcctttgtttatatgtttacatatatgtcctttgtttagcttcagaattatctcctaattgtcttcgtcattatatgccttattctattgtacagtaaataacatttatttatttctcacaaataagtaacttcatactgaatacttttcatgatggatcatctgctatcctttgtttgcaatagcagctaaaagtagcaccaagtatattaaatatcactagcagaatagtttgctttcacataattttaggaaaaaaataatatctagaaatatagtattttgtgtcaaaattaccctccttgaatgaggcagtcaaagtaggtttttatagagcatctgtttgctgtcactgtttctttgaagcatcttgaatactattttgacactgttacagcaaagtattaactgatgcaacataaacacaatttaactcagtattaacaggacagtttgacaagccctattcaatgaagaagaacctacagccagggaaaaaatgcctagattctaatgcatcaacatagatattgttttgcctttttattatatgatgataaagtagaatctactagataaaaataaataacatgtaaatagatatttatatcaagactggatagtatacttttattttaagaaacacccatgcaatacttttagtctccagtctaaaaagatatttcacctcaaatatctattttattttatttctactatgtctattgcaatttagttctgtgtatcacatatttactgagtagcctgcctggacctatacagtaattaagtggtatgaagagtgtgtgtgtgtgtgtgtgtgtgtgtgtgtgtgtatgtgtgtgtgtgtatgttgcaaaaatattggaagaagtactttctttattttttattttttgtagagacggggtctcattatattgcccaggctggtgtcgaactcctggcttcaagcagtcctcttgctgcatgctccaccatgcctggctaatttttgtatttttttgtagagattaagtttttgccatgttgcccagactggtctcaaactgctgagctcaagcgatctgcctgcctctgcctcccaaagtgctggggttacaggcgtgagtcaacatgccagccagaagaagtacttttaatttaattttgaatttcacctgcaaacatctgcatgagatcacattcagagtaatgattcttaggctttgtagagagtgtggaattgttgtctaggtaagtttctttcattggttcagatgtgggcctcttgaaagggaacattgtagatgagatcatatgccaaggctacctcctcattggtgatatcctgtttcagttctcattatagttctaaacagatcagaaaaactttttttttttgatgattcattggcctttgagaacaatgaaaacatgttgttttggccttagttgatctcagggatgccattcctttatgtacttactttttagttaaaaggattcagcaactgtcagagaatcaaactgactttgcaatgttttggcatcttattgctagaactactgatagatatggtatctcaaggatgacatgcaaggacttttcctagttggtccccactactacttttcttcccaatatgatatgaggaattctgaattggctcttttgtaaagttttcagggtggcaggcaacacagtgacaagaacacttgtaaacagtttatttacattcaatggattatatttaatcattttatagttaatttgcgtaaatctctctctgtggaatgtccacgaaaatgtttttggttggtgacaagcaacatggtagagatgcagagagtcgtgaggcccggattgtagcccaagatctgttatcctctttctgtgtgatcttgggcaagccattatctcctctgagttggttttctcatctgtgaagaagacagattacaacatctctgaagctttacatcttaaagttctaaaacttttctgtttaatagttaaatatatataaattttctactcaaagttttttttttagaaaataaatgggattttggcttctatataagtaacaattatacaagacattgtaaatcccaatctatgatttataggttctaattgaaatacttctcatgttcatgtctgcatagtgccaacacatgtggataatgatgactttgcataagattttgtctgtatgagtttcagctttcagtggaaagctgggtagttaagaaccacactatccaagaagctgggaaatgacttattttgattaatcaaaatacaatgtacagataagctggttgagatacccgaatctgacaggacatttaaaataaactggcaaagatttatatgagccagtctggctgcagtgtgcacctggtgggttgtctggaagctttgatgaattagtagtgatgtcagaagacttcactataattctaggctagaatattgccatagggatgcagcagaggacatctggtttcacttcaatttatccatcagagccaacaatttgagtgctacagggacaagccctagagaagcagattttaataccatgcacctgatctatgatgggttcttatttttgagaatggatgggtatgtttaagtacatttttaaaaattgtagtacaaaagtaatacatgctcactgtaagacattgaaaactactgaagcatatacatttaaaatatcctcacccccagccaccccaactctcactctcctacggcagccagtataagcaaaattttatatactttattgaggtgttattgacattcaaaaagctgtatgtatttaaagtgtacaacttgatgagtttggaggtgagtagaggcctgtgaaaccatcaccacaatgtatgccataaacatactcatgacgtccaagagttttcttctgccctctttatgatggtgattagaacatttcacataagatctctttgtgaacttttaagtgtgtgatacagtgttgttaactctaggtactatcctgtccagtagatccgtaggacttgttaatcttgcataactgaaacttaaactttgtaccctttgaccaattcctcccagttttctcctcctctcggactctggaaagccactataaattttatatagatctttgtaggcctttttctaagtatcccactattatattatattattgtaatttagaattttagacttgactgaatgcagataattttgcattctgtggactgatatgaagaagccctttaatatttttcagtaaaattgatagtctatcagtatactcaaatatttgtcctgagcttcttgccatgggccagtcttgggcagttttctaacttaaatagtgatcttgcttaacctaagtcatgtagagcttgttcagtgttggataaggagatggtgaactataaatagtataaggatataatttatcatccaaactgggacattttgagagtccttaataattacactgggacaacaggtgtaagctgggaccgttggacatttggtcactctaaaagttgacaccagcacacttgggaccacttgctttccagttctgttccatggttcctcattcctgtgggatgatatagctgtgaactctactgcatttggtcattgaccttaaatgaactgatggttgatcgcctcttgccctttggcttctgtaatagagaaaccacagtatttcttagggagacttgttagcacccaacatcagactaagtttcttaattccataatcatctagtgtctgttctttccacttctcacttcctagtctcttctcagttgcctccagctgggcttctcttgccaccattccacaaaatcagcttttgtttatgccatttatgacctccatgttcacaaatctaggggtaatcacatctctgtcgttagttgatacagttgatcgttccttccttctcagaatatgttcttccccttattcctgtgactgcacgcttttccagcttctccccactttccagtgctgccttcttagtatcctctgctgaatgcttctctgcttgtcctctgtgttgaattgccccagggccctttcctacccacagtcacacttttgtggatgtagtaatcatcttcatgttggtgaatggttgtaccatgtactgaaatggaaacacagagaggagcaggtttaatgtggggtggggaagtggaaggtcaaaggctctgttttgggtttaagatgtctgttacaggcctggatgacaatgtcaagtgggcagttagatgcatgagtcttgagctcagtggcaggatcaggcctgatgagttctgtcatccagcctatgtaatttactgagcagttaatggcgtgctacacatttttggagttataattacagtttaggctctctaccttctcaccagatcatccctaaagcctttaacctggactggctagatgaagtgtcccttggtattctgttccaattctttctttctcatcacgctcattctctgtcatcctgtgagtcaccacatgtcccgtaacgccacaggcaaccattccttactcatacaagagcggatacattatcataggtatcttacaccgtgtcagcagttattcaaaagccaatctttaaattatgcagcttttctgcctcaactggtcttcatcagctgtttatcaccatatttctattgctaattgcataaatgaagacagatgcaggaaactctggatgtgggatgtcttctttgaaaacgaatgctgctaacgccattttcagaacgtctgctacaaaattccttctataaaatggtagctatcacatatgtgtgtgaatgtatgtgtatatatgtgtgaacacacgcagacacatacacagttggggttgcagctgttcctcacagttgtccgataatctgttaactgaggtagtgtccatacagtttctttgaggcataaaatgattatacactgggcagcaaaactgcagcctatttttctactctgatagtttcatttgtgttacctcttcaagaagaagattagaattaaattgactaggcaagcaaagctgaaaattgaattaatttcagatttgtaataaaaaatgggatctctcctactcagtgttaactaggaccctgtaggctatacaaactaaactgacagtctctcattaaaatgatattttctccagtgaaatgtactggcactaaatagtctctgaaatgctttatgctgcaggaacacagctgccttcaggattatggaactgagagcagttttcatgaatcccgtggaagccacagcatttattaaattgttgcaattttaccaactatttatgaaattcctgctttgtgccagacattgtgctaggcagtttggataaggaaggtagttcatgattcttgtgatgaaagagcttccaatctaataggagaaagtgttacatataaaacgaagcttgaagtgacttggttagtggtgtgagagaagtgctatggaaatatgaacagaggtgactaattctatccagttggtttggataagaaggaaatgagtaatgagaggtgtggactttgaaggatttcaccaggaagaaaatagtcatatggaacggtgaaaattataaaacatttcatgtcaagttaaatactatggaattaattcgatttttactatatggtttgcctttaaggagatttgataatttcattccaagatacaatttcccctaaactgaggctacctttttgtttgtaagagtggcaaaaatttactgaatgcctaccatgtgctgtgtgtgtatgtacattcccttattctacacataacagcagctctgcggtgtagttaacattgtcaacagtagatgggagaggtcaggagacttgtgcatggttacacagctggtaagtggcagagctgggcttcacacccaggtctgttcctctgcagagaccatgtgtttctcccacagaacactgcctttctcacacaggactgttaacagctgtgactgctggtcgacgagggtgatgacattgtcagagtccacgtgtacaattctggattaatttaaccagatgctacatttggggaagtcttggaaccaaatacttctcagtattttgttgacttgatggtctgagagcttaggtgttggttaggcccagggtagggcaacactgacctttccttctgtcctcatgtccgaaagtgactggatcttggaggatgagtcccagttgctaaagagagtggtaagcctctcagtggccccagatgagctgcctcaggagtgccagcctgtgggcggctgggtgagctaactgtccagctagaggctgtggctctcccctaaggtactaatggttaaggctgctggctatatgagagatattttctcttggaagtaaccagagctacactaagtgacctcagtccttgaagactagaaggctccactgagcagtgaggctgagcatgtagcccaaagccggggcagcaagacactaggacaagtttcagaactgcgttccctgagcacttctatgtgcccacctcttttctgtcagtgttccaagccagactgtcaaattgcttatctcagatccgtaactgagcccagtcttcccctcctgggccagtggcagatcatgcctggaaggctgagctttcttccacccctcatcattcaagaaaggaagagacattattcatctttggaggggaatttcaagactaaaggagatgtatgaagtattggtttctgacatctatgtctctaggcaaaacatcactaggcaattatttccaatttacattgtctaagctctcagatgtccatggaaggagccacatttctgtctctcttctttcatctactgtatttacaactgggaacttctttcttgcagctaactttaagtttgcacactttatttgaacatccatatctgtttcttctgtgctcaggaattatgaaattagcgcttctcctaaggaaaagtatcacagaattttctcccagaggcatcttagtgtggcatgagagcataagctttggagtcagatctagattcaaatctgtttctgctacataccatcaattcgatttgatgactggcacagggcctccttttttcttgttcctttgctgtcctcaagaagtggctgctcccactccagccttcatgtctgcattccagccagcaggaggagaaagaggggcactgctaagaacacttcctggaagttgcacacatgacttccattttcatcccaggggccagagcatggttgaatggccacacccagcagactccaagggaagctaggaaatgtctttattcttggcatttatttctgtaaaagaagaggagtgattatcataggttgagtttcctaggaagcagctctgagacgaagttcagcttgcaaaatgtttattggatcagtagtgatggaagggagggcagagagagaagtcaggatactatgcaggctccacaggatggtcaggcctttatgttcctacattgatcagtcattaggtacaggccattatgggaagaagggtgactgtgggtgagggagccgttggaagttgaggtgatccctgaagagcctgacagacagaggccttctggccaacagcactaccagcaacatatccttcatggaagggggttctggatggtttttagcctacatcacggggagaatggaagagctagcatctctgctacactacatcatagggtggttgtaaggatcaaataaaataaaacatagaggtccttttgcaagaggacctggcttatggtaagcatccaatctatcttagatgtggtattagcatttcccaaagttatttttacaagatgtttttctccccgaggatcttgtgggactaaaagagttggcatccctagtctaatgatcaaatttagaaaatagtgtattgcaaaatctttatcttctactctgtgtggattggtctttagtcaatgcttctcctaatgacttgcattagaaaagatagtgttgacattgcttttgcctttgtttttcacccaagtggaaatacagaaagtgcttacaacatgtaaaattctgtattgttgacattcattacttttgttaacaaatgtgtcacatagaaatttcctgaaaatatgatcaaaaaatgaaaaagcaaatacttagtgagcagacatgcagtggggggaccttcctacccagtgtgagccagcatttctcacctgtgcctctatagtagtctaactggtgtgccagttcccactttttgctccaggtatagtctattcattatggtagccaaaataagcctttaaaatttttaaatcaatcttaccaattccttttactctcaacccttgctgcccagtgtattgacagtgaaatgcggagtccttgccattcctcgctaggccctgcaggcactggcccctagccacttctctgaccccatttctgtcccagccattttgctctagccacactggcttctttgctatttctcagataaaccaagcaagtgtctgactcaggacttttggacttgttctttcccgtgcctgaaacgctcctcccctcgatttggccttggcttactccctcattttgtgcagatttctgtgctcctcctaacctcattggaggcctttcctgacctctttatataaaattgcacctcttgtcaccctttatctctctcaccctattttattttattcatagcacttattacaacctaaaactgtgtatttaatgtttattgttcattgtatgaccagactacaggatctaagagagcagggcctttgtttttgcttattgctatatccccaggagagtgcctggcttcaagcatgcactccacaaatttttgcaagtggaggagtgagtgtgctggattctggaagtacagtagtaccctgcccttgtggaatgggaatatatagtctacaactaaaacccattctaacagaagatgcaataaaaattatagaattttctctttaaatatattattgttgtaaatacccatagggtttctaatattgagccatccttgcattcctgtgacaaccttacttggtcatgatacacaattattttataataatatactattcttaagatttggtttgccattatgtattctatttaatattggcaagtaagaatggttttctgtagctttatgatgtctttatctagttttgataaccataagccttatcctggttataccagcctcacaggggttcaacctgccttattttgttgttgttgttgttgtgttttgttttgccttaggcttttagcagcccaaagccatgttttttagtttctgactctagtgataagtggaaaaggaggaggagaaaggggctttattggcccaaccagaaacagagactaagaacccatgactatattctctcccttgtcaagaactctgttaatctaggttttacagaacttgcctgtaaaactgcctgggctcggtaccttcgtgttgggtagaaatttgtctttatacattttgcgattattgccccatttaattagttcccttttcttgagtcagtttttatacttttattttctgggaaagcttttatctatatttttgaatataggtagtaggctcataaaatcttacacgtatattttctaatattgcttatttgtgttttctttcactggttttaatcaagcttggcaaatttttttctactgtattgttgtttcatttatgatccctttgatgaggggatcattagaagccccaactccagcattatgcaatacatgcaggaaatgaacatgcacatgtattccctgaatctactagaaaaaagaatgtctcctccctcccctcctgtgccaccccacccccacgtcctgtttctaactcaaccttggatattttacaacatatattcagtttgaaagctaatactgataccttgctttatatgaacatttgtatactgggaccctggtgagggactgacttcattgggatagtttatggcttaatgcatctatgtgacttatgtcttgttttctctaagtatttatcctaataaatttaagagattctttggtttaaaaaaaacacctttgattttgttcattgagtctactttgttgttattttattccgtttcattagggtctctttttattctaccacaattgccagagtaaggacagctttattgccagctgcagctttgctgtccacatcgccctgtgaggcctggagtccccaaagactctaacctactgatatttgacctcaatactcacagaaggaagtctgctagccctgaaaatgaatacttcctttggtgcaaatcttaaggttttagcatggagccaaatgccttctcactgccagcaaattatttagggtgggggtggaggagttgtgatggtggagtgatggagaggagcctataagtagtccagctgctctgcaggatatcatttagttgagcgtcctgatggcttcttgactctgagcttggacttttatgctcactttttattgcaggctttttgctttgggttccatgtaaatctgagtccttcgctttctgtcttccacatagacctcaaaacttttggtccactattagcaccatttctcagtacttaatttttaacaaaacaagacactggtatgatcttgctttggaaaggggaaatgtaattactatcttggtgtgtccttatggtcctcatttaactcctgtattttgtcattggccatgtgggagagatgggagtcatgagttctgttgggcactggaatctttttctcaccccagagtgaccaatctgccctcagcttagtgatttcaggagcaggaggagccctttccatggctgggtacatggagtgttacattaatgggtgcttgctcgaaagtacccatgttttctttggtaaagaaactatcttaaaatccaagatgtgggttatttgagaatatgatttatttatagcaaatttcttctgacatcaaaatagacttctgaatgaatttaataaaatttttggggaatatttacatatgaaaaaataccactggttctattttaaaatctaagcttgtagagaaacaaaagataaagaaaaaatgttcagctctataaaagataatctaggcattcatcacctaaactttcaaagagtggaaataatgtcttgactttctgttttttcttcaactgtttggggtcatttagacatgtcagggtaagagtttttttccatttatatgtatctgtgaatctctaaatgtttagcttatttgggattatgtcagaatgtgcaaatccagaattaattctcaaaagaaagtgagataaaatcagtttaagatggcaagtgaaggatttgtataagatttcattaaagcttattaaatgtcgaaatttattcctaaagaaggctctgaagtttgtgctaaatatagaaagagaaggaggaagagagaagggggagaggagagagaaaaaagagttttctgtctgggatgaggagaaagttgtacccccctcccaaactggggctgaactataattctgaccctcaaaagtcagctacgtttccaaatgaggattaccatcatggccattttatcactctgtgcgagatgctgacaccatgcactaagttttgggtcccatgtatttctttttattgtggaagagaaaaaactaaaatataattagaagtgcattgttaggccgggcgcagtagctcacacctgtaatcccagcactttgggaggccgagacgggcaggtcacaaggtcaggagatcgagaccatcctggctatcacggtgaaaccccatctctactaaaaaaatacaaaaaaaattagctgcgtgtggtggcgggtgcctgtaatcccagctactcgggaggctgaggcaggagaatggcatgaacctgggcggtggaggttgcagtgagccgagattgtgccactgcattccagcctgggtgacagagcaagactccatctcaaaaaaaaaaaagaaagaaagaaaagaagtgaattgttaaattaataaatatatcaaatatataaaataactttccttacactctttacaattatgatagtaagaatgaactaacactttacactttcacctgagaaatgacagagcttcagaatttgatttctttaactgtagagtattaatgaaatccaagatggtattttgaatgaaagaaccaacaggaagaaaaagccattttggtgacagtctcatgaacttgtcagtggtagaactagggaagataatacaaaagttttgacatctcagttgcttgccaccctatctgacatggcactagcttgttcttttagaatataggaaggaggggctgggtgcagtggctcacgcctataatcccagcactttgggaggccaaggtgggcagatcacctgaggtcaggagttcaagaccagcctggccatcatggtgaaaccctgtctctactaaaaaaaaaatacaaaaaaattagctgggtgtggtagcgggtgcctgtaatctcagctactctggaggctgaggcaggagaatcgcttgaactcgggaggtggaggttgcagtgagccaagatagcaccattgcactccagcctgggcgacaaaagtgagactctgtctcaaaaaaaaaaaaaaaaaagaatataggaaggagggcctggtgtggtagcttacacctgtaatcccagcactttgggaggctgaggcaggtcgatcgcttgagctcaggtgttcaagacaggcctggacaacatggcaaaacaccatctttaccaaaaatacaaaaattagcggggtatggtggtgtgtgcctatagtcacagctacttggaaggctgaagtgggaggatggcttgagcctaggaggtgaaggttgcagtgagccaagatcctgccagtgcactgcagcctgggtgacagacccagtctcaaaaaaaaagaaaaaaaaaaaaaaaagaatatagtaaggaaggcaggagggaggggagagagggagagagggaaaaaatatctttacaaaaatttaaaaagtggaacaagatgattgtaaaaccttcaaatgatacggaaatgtacaataatacagagttaggaggtgggactcccactcccacctcctaattcggctttccaaaggtccctactattcacggttgtatattcttcaaacatttatctgtgtagaagctaacacatgcatttagccaactgagaggcatttattaataatcgtttacagttttttactattacaaataataacacaatgaaatgcctttttacccattagtataatatctattgaaatgtaattagaaatgaataattagttagatatgataaaaatgactttcagtctgtaaggctaaacaatttactagactagattgttcaaaaatcagagtgatttaatataccttagcttttagaatgcattggcaaaaatgacgtttgtagctttagacttgcatagatagatagttgactgtcccagaaatatttgacctgatacagagatcttctttgcacatgcttgctttctagagagggctgtactggagtgagtggataataaggctcttagttcttcctatattctctattcattctccccagcaattaagggaactgtgtctataatattggagatctggaggagaattcaaggttaaaaaagaaatacaccgttattatgttaattgtctaagataataataattttgattccttagggaactacctcaaatgtactacacagtttttgatggaatatttgcaatctggctataaatatggaatgataacggaatgagatattttcatagaaacatagtaaaaggataatgctgaagaataaactacattatggcttgtgagtcacacgaataatgatttgaattatgtgactgtggaattgttgcatgagtataatagatggttcattcttgcctctaagcatttgacatgctacttattatgaaggttcaaatcccatgcttatttataattctttgggcggttaagaaaggaattattagctctggcatcctttatttgtatgtaaaaacgtgaaaggtaatactatatggttttctgtataagaggatatactactgaatagtaaaaataacaatttacctttattaagtacttactacctgcctgcattgctctgagcacttaaacatggaatgatcccaatgacccaactatatatacatatctattattatcccctttttacatgcgaggcatagaaatggtcagtatcttgcccagggacacacagctagtgagtggcaggctggcataagtgttgagagacttttctggcagtggtgatagatttgcaaggagccagtcatccatttacattcttgtcgagacccttctgtggccaataaatcgcatggattttgaaaaaagtgattcaggtaagaagatgcagctgatggctgtggaatgggaaatagtgtcattctcagataattggtccacataggaattaaaatattaccagcatgcttaaactaaattatgacacttgcccaaattatggcagtcaccctctacttcacctgagtgaaaattttgaaatctaattgtatctagacagtactgacaaatcattgaagttagagattgctaaatatgttttaaagctcatatctaatactaaaaaacatacaagtgttatagtgaaatactagcatgaatttacaagtataaataaatatatatatgtatattttattctattttgagacagggtctcattctgtcacccaggctggagtgcagtggtgcgatcacacctcatgcaggcttgacctctctgggctcaagtgatcctcccacttcagcctctcgagtagttgggaccacaggcacatgctgccacgtcccactaatttttttatttttttagagatggagtttagccatgttagctgggctggtcttgaactcctggactcaagtgatctgcccaccttggcctcccaaagtgctgggatcacaggtgtgagccaccactcctggactacaaatatatcttttaaatttcaaattgttaatattgagttaccttttctacttttaattacagtgcatgtaacaaaaagttttctctattttatgccaaccaaattgcattctgtattgtattgaaactaggcacaaagtaataaaacatttaaaataagtctatgttctaactaagttttattttgaatttccctatcacttcaaaagtatcttttctgtacgtatgttaaattttacttcattgttaatcttctttgttgattagttcttttccctgatatttccctaatagtaaacaaaacctttaaaaatatttacaaagtgtcattttatgtttcatgaaatattattttgggtttttaaagtcaaatttttatattgggaagcatgataaaaatgagattttagagtaattgacattttgaaatattagagagatttcctagggaaattgaaaaagacatgattttcctaaattggggctattttattttcctgaatcaaattcaggccttgcttttacttcttagatcttgttctttcttctgttccttctgtaaaccaactaagacataaacactgattatctgttactttgttcttgtatgacttctcagttttttgtaacgagtatcatgaatgtgtctaatcaaatcataaagggttataagtatctctattagacctacttgtattttttttttttttggctaaattctgtcttcttgtcttcttctctaagatgctttagtattcctaccctcattcattgttcatccccacccacctccattttgttttaccctcttactcattgattaaaggccataacctccactagtgagaatgctgggttcagacctgtgccaccacttgcctaccgtgtaacctatggtgaaaaccaggcgtctcattcgtaaagagaagaaaaggttagcacctaatttagggctgctgggatgattaaataatctgtgtaaagggtttagcttcctgtctaatatatagcaagagcccagtaaatcatagctgtttttattgctgtcattgcccaattagctctgtccttgtggaatattctacgtggtagggaagttaatataggtatgtatgcgtgcatatattatagtcgatcagtaaataataactaataaaagttacatcatactgtattacatcctacatagaaaatgctttattacaatgcctgggaaatgtcatttactgacctcatgtcttatctcataaaataagaaattattcatattccatggcaattgatgtatatgcatatttcttttttattgttctggatataactatgtaatgaaacactctgttatattgcaagtaaaaatcaagcttaagtctagatttttaatttatgctttaaaattttccctttagctagtgtttcaaataacattcagaacatcacaaattgttttctgtaataccattaggtcagtttgtacacagcctttaaaagttcttttcatatctggaacaaagctgtagttgattttagatttaaggaagtgaaatagagacatataccttttctcaatctaatttaaaaaatttagtcaaatgtggatatctggtgtggcaaggaaagaattgtccgtgtaattagctgtagtttatgctgaattgcggctagtttgaaacgactgtgatgattatattcactgaaatgtttttgaggcttgattttttaaaaagattttgagaagacaagatttttaaaaatgagattaaaataattcttactttcaccaccctaaaaattgactacagtattttctttttgtataatactataaatatgtatcattgatatacttgtaatgagactgtacatgctattttgtattctattttctctcatgttaatataggtaaatccacattgcaagattttaaatatctgcacattagtgtattattatgttcatgttccataatttattgaactgtttcaatttttttttgagataaggtcttgtggtattgcccaggctggagtacagtcgtgatcatagttcatggtagcctcgaaatccagggctcaagtgaatatcctgccttagcttcctaagtagctaggactacaggcatgtgctactcatgcctaattatttattttttttgtagagatggggatcttgctatgttgcccaggctggtctcaaactcttgggctcaaatggtcctcctacctcagcctcccaaagtgttgggattataggcatgagccactgcacctggcctgaactgttctttaatgttagatctttatgaagttgtaaatttttaaatcaattagcaagcaactaactatattgtgcctatcacttttttgctatattagaataaatatttatgagtagaattaccaggtaagagtataaatactaataaaccttttgcaacttgttaccatatgtattttcaaaagtgttataagactttaccgtaccactaataatgaatttgtatagcctgctttgccaatattgggtgttacacatctgaccctcaaataaaatgggacttagggatgctacccccacccccttgcggtgaaaatccaagtagaactttctgactccccaaaacttaactactaatagcatgctgttgacaagaagccttaccaataacagaaacagtccattaacacatattttctatgttatatgtattatatactgtattctttttttttaaatttattttaagttccaggatacatgtgcaggtttgttacataggtaaatgtgtgcacctatcaacccatcatcgaggtattaagccccacatgctattcttaaaggaagctagagaaaacaaattgttaagaaaatcataaggaagagaaaaatacccttacagtactgtattgtatttgtcaataccataagagtacatcatctgtttacaggatgaattgtctgtctgacatagcaggcaactgcagctgcagacctcagtctatggcaaatctcaagcaattcaccattttcttgtaatatgatgacttttctgtgcttctttgggaacacctccagcctagatcactagtggcacttcacagggggtcccacagtgttatttcaggtttatagtattgcactaaacatgatgaaaaatacgagagaacttcaagagatttccacccccccacacacacactttttttttttttttttttttttaagacggagtctcactatgttgcccagactggagtgcagtggcgcaatctcggctcaccacaacgtctgccacccaggttcaagtgattctcgtgcctcagcctctcgagcagctgggattacaggtgtgagccaccacgcctggcttatttttgtatttttagtagagacggggtttcaccatgttgccaggctggtcttgaactccggacctcaagtgatcctcccacctcggcctcccagagttactgcctcagccacccaaaggtgtgagccactgtgcctggcccccatggccttttaagggatactcacaacacttaagttcaccacaatagcaaagtactacagaggtacagtgtgcactatagttaattttatgcagttatgatttaatactgcatctttatatgtgtttacatttatctcgactgtgaatgattccatgtactgtctgtgtgtaagttttcataagttttaatgttttattatacatttgtataaattttatggtagcaaatgataaaatagaccagtgtttacatatactttttgcattcatgacatatctctttcttaatttttttcagtatttctaggctacacggttcatttttgagttttttcaaattgtcacaaatctccaaaaaaatgttttagtgtatttactgggaaaatttgagtataagtgaaccagcacatttcaagcttgtgtcgtctaaggatcaactgtatatataaatatatatatatatatttgtatgtgtgtgtgtgtgcaatttagggcatggttatggccaggaggaagtggagtggctacccagggtgttggggtaaaggagctagaggtggagcggccacccagggtgttggggtaaaggagctagctgagagcacccattgtagggagccttctgttttttctggtgtaatcaatttgagaagtcccaccggggcagtagaggaggagatggctgggccctgtggctcctatgcttattccctgagtgtctcttttccctggaagttttctctctgccctgtcttcaaggagggtcattccctaggtctctagtcccagcccttttttgctactcttatcttaaacaccttagggtagcagaaagtaccctggactgaggtgttacaattcttgacagcaaacaatctaggtatttacataagcagaaagtcacttattgaagggtattgggacattcacaggatctctaggagagccaaagaccacacaacggagaacagtgctcagccacagtggggtcccctcccctgctcaagtgctgctaccgcacccgctacctaccccaccagtgggttgtggtgaaggaagaatctcctgtaccctttcaggggacatagcggtatagggaggtggacagtttacacaaggtagaacccacaacacacattcctctccattatactgagtttctggcaaatattataggactccattgagtccagatttcaacaaagaaatggagcaaacaattagaataattcccagatgctcgagtttccatgttgaatccagaggctctgttaagacagctggtctctaaagcccaggttaaagtaatgttctcccctttcctcggaattcattcccacacaggttccccaaatatatactggacaagtgaaacttgttaaacatatacaagtttgtaagtttgcaaaatagtgccattcttttggtgtgtaagcctttttctctcgggcttgactctttgtttgactcccagtgcagttgaaatctgcctctgattatggatctgggaagagtggggcagggagaggttagaacatgagaagacttaggttctttttgaaagatgagtgcctcaggtgtgcccactgaggtctccaggccaggcaggcactgcctaagtaggttcagcagggcttcggggagttgtgcagtgtgcgttggtgggagagaaagcgggtagggggctggttcaggggttggtagttctcgaagtgaccaaatgctctcattttcccatcaatatcgtttcatagaaatacctgacaaggctcccatggtctgagccttgtcaatgagatgggtgagggttgggggggggtctttgtgtgaacccagatgtcagtttttaatgagaatttcaagtatttatattttaaaagtaaaccagaggaagattgagttatgaaaagattgaattgtagtcatacagacctaggtctgaatcttggctctgccacttaccagctgtgtggcctgggcaagttccttaacctccgtgagccgcagtatgtttgtctgtaaagagagataagtttgtttatcctattggattgttcttgagcattaaatgagataatgtgtaaagtaccgcatagtaattgatcgataaatagtagctaatgtcactgaatgattaataaatgcttatggaactgaagcaatctttagcaataaagtggagcattttgctcatggggaacttgggagtcgtgtctggagatgtctcagtctggggtacttccttaagatctcaaatcagattttataggaggtttgtttcacatgtttaaggtagcctgtgtgtttaggtggaatttgttcaagtgtccattgtcataaatttgtttaatatcattgctccttctgcatcaatttttaggccagacctaagttatttgaaacccggttgtacacaccccgtcccccgaggcctagttgaaacttccctcacctgtgcggtggtttctgctgtagcctgcctgttcctcatctcgcagacccaaaaacccagcacaccccacagctgttgaccatgatgaaacctgatggtcaacatcagagtcaggtaaattagaccccctcccttcgcacgtgttttctttaaactagccaaccactgccctgtggaaagcctacggcagaacacccgtggaccttaataaaggcttaggtcgccaggttctcgctcactcgctcgctagctgcccacttactggttgagcacataggttccagatggctcccgcttcctgttggcctgcaaggcgggctgccctcttctctctggcatctgtaagtaacaccggcttctgttatttcatgtgttttgttgtgccggctcctgtgtctcacttgaacctaactcccttcctggtcagggctggacccaggtgagagaagatctacaagggtggctgccactataaccgagttttctgtgagaggggcatctggtcatgtgtccacgcttaggattaggcgtccagctgggaaaagaggtattctgtgagaaacactataaacatctggggccgccccccgccccagcaggtctagaatcgatagctactctccagagagagacctcaagaccaagttagaggaaaattgaagcttagcaaaatgatcaaacaagatttcgccaaaataactggttatttggctggttatattaacttgtctaatagaatggcttatcagtcattttattggaaattcctgttgttttggtgtgaaacggtggtgaacactaattggctttttgaaaaatagggccaaactcttcagaacatatattttaggaatcaaaacattatttctcctgaagtttttattgactttattgtttaaaatacatgtttcatttccattggctagatgaaaaatggaaagtcatttctgactggttggagttccatagacttaacgctgaatccaatggttagtaacattggctttctattcccttctccatccgccccaccccctttgccacttgcttacatttcttaataaaatgaggcaggtttgctatctttttgctttttattctttcttatatccatcatctgttatcctttctctttcatgtgttctgtctctgcttaattccttcagcactttggttttattccaataaatagcttctggaagatacttgcgtaaacaaacaaaaacagcaaaaacaatgaaacatttaatttttagcaagtgttatggtgacctttagaaagaatgtgctttccggccgggcgcggtggctcacgcttgtaatcccagcactttgggaggccaaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattacgccactgcactcccgcctgggccacagagcgagacttcgtctcaaaaaaaaaaaaaaaaaaaaaaaaaaaaaaaaaaagaaaaagaatgtgctttccaaagtagacatgggtgggacgtaactggcccacctgatgttgtcttccgtacttgtattggttttcttctcttcttctgtcatgtgccagatactgtattggatgctttacaaactctaccttatttaattatatcctcatgatatccagaagggagttaatattctcatcttgcagatgagcaaactaaggctcagacatggtcctaataggtagaatagaaggaatttgaatccagagttaactccagcacacatgctgctttccttaccagggcttgcttctacctaaatagtaagtacagggagagctttatgacacagaatatctacaaatactgattgacttctctggctcttggacccaaatgagaatgagcttcatggtatgtgtgtgtggtggggattcatcttatttttgcaatgcgtatatgtgttgtatttttaaatgatgaaaaatgcacaggtaacctgtacaagagggagatctaagaatagtcagcattaagtaaatatttgttcaaagaatgtcttccgatgacattgcataatttcagttcatatatctgaaaacttagtaatgactagtgatttttataagagagattgaatagtgggcacttatttctaatgagccaattgaaaagcaaattagataacttgctgtgtgtatggtgacaattcatccactttctattttctctcccactgtcttcccacatatgtatatattgttttcattgacatattagtgagttaactaggttaatttttattgtgcccagaaaatacttaggtaatttcagattcattgtggagcggggaagcaccctaactctgtgagctgtactctgaattgcagagtaagtttacaactagtgggaaatataaacattgacaatatttgcactcttaatctgtgtgtacaacaccatactctattgtcaccacccatttcacggctggagggtccattcttgtatcattcagataccagcatttggaagccaaggacctacattttaatagacttagaagcaagaaactggttatatttttgacgtacttatcaccaggctttcccacagttgatcattcacatccatattagtatcaggaccctattgtgtatagaggacattggtaacttaattttcctttttttttttttttttttgagacggagttacgctctgtcgcccaggctggagtgcagtggcgcgatcttggctcactgcaagctccgcctcccaggttcacaccattctcctgcctcagcctcccgagtagctgggactacaggcgcctgccaccgcgcccagctaattttttgtatttttagtagagacggggtttcaccatgttagccaggatggtctcgatctcctgacctcgtgatccgcccgcctcggcctcccaaagtgctggaattacaggcgtgagccaccgcgcccggccggtaacttaattttcaaactttgaagcaaacagtcacaggcctaagttattgcattatcaccattcagcatttcttctgaataaatattacaaaaaatataataggtgtgaagagaaattcagagaggtgagggaggacgtgtagggttttcagctttatttcctgcttctcctgagttgcacgtgggaacacagatgatgccagtacatgcctgatcgggaagtgacggcacagttacagtcctgccggtatgctcacgcaagtgggtctttttctcatctcttttgaagataatttattgggaaggtgcctacattctgtccagtttgatttcaacagtggtttgccaaaatgagaatgagtccgaatttctcactgaaatctatgtatcttcaaaattaagaaatccagcagtactaccccttcctcttgtacctgtgatacaagtttatccatcattgttggagttcaccagcaatgtaaaccctgaagttgatcagtttgtccccacttctagttccagtcagtggattctataattagaagaaagaatggctgaggtactataataaaatatttaccttaaacaaagccacaccggtatcccttttgttcttctctccatggctctgggtaaacactataactgtgatgttagcctgcaggctagagccaagagaactgaagattgacaaaaaaaaatgatactggaggttcagtagtgtccaccctaccgtttgccctccgcttgtgaagtccagccctggattatactacaaagtagctgtgctcttggacaagtcatttctcctctctggctttggttttcttcatatctgtaaactgagagggtgggatgagattttacttgagtttccttttagttctgattctatgaaggagtaacatgtcttgtttgactcagaaaatcctggcgatctctttcaggcttattgtagtgtttattacagcaagctctttagaagcttccgcataagcagacatcagaatgcgcctggacctcccaaagtcatctggttttcttcagttttttaaaagttcagaaatgtgatttgtagaaggagtaatagaagggagtataaattacagtgggaaatgggaaaacattcatcttaaagccatatatttctctgtacccttttgacatgtaatattttcttatttctattgtgttgggcagaatgaaaaatgggtctcgatatattttgtccctttaattgtagcctaatttattaatgccccctgggcttcccctatattattggtggcagtttctctttttagtaagtcattatgcagatctttggggatgactgtcaaaatgcttaataaaaacttgatagctaagctaacttttgatttggggctttgaataggcatccgatgcccctgcaatctcactcctagatatctgaccaagtggaaaacttattttcacacaaaagcctgtctgtaaatgttgatagcggctatatttgtgattgccagacacaaggggcacaggggaaatttggaggtgatagaactgttgcgtatctgcattactgtggtggttacatgatcacagatgtttcaaaactcacagaactgtacactaaagggtgaattttcctgtatgtaatttatacctcaatttaaaaatgtgaaaaaatactgctaaaaaagtttatttgaagtattttttatacctaatactatgggcactttgggataaaatagaaatacgctatagaaatacgacattgttcacaagggccttttaaggagattgaaatttaggatttctaaaaagatgttatgaggacatacggattattggaagtagtagttacttctgtcagacaacagaggagttataaaaagcaaaaaaaagaaatgatttttaaagttatagcatctgagctttttcttaaagttggtttaaagtttttgatctttaggcttggtggagtggctctcaactataatctcagcactttaggaggctgaggcaggcagattgcatgaggccaggagtttgagaccagtctcgtcaacatcgtgtaactccatctctacaaaattacaaaaattagctgggtgtagtggtgcatgcctgtaatctcagctactagggaggctgaggcaggagaattgcttgaactcagtaggtagaggctgcagtgagccaaatttgcaccactgcattccagcctgggcaacagagcaagactgtcacaaaataaaatttttgatctttcagcgtttgcagggcagtagaggggaggagaaccaagtcataaaacacggatcaactttattttcctgaagaagtataaggtaaatatgtatgagtaggcttttttttttttttttttgggtcccagcatatcgtaactacttttgacaatccctgtttctaataaaatgtatgcaagcatatctttgtatatttaattttttctgtgcaattcaaggaaggcaaatggttactatgaacactaaatcctgtcgaacttcctcacacgcccgcaacataggcaattgtttcaaaggctgtggaagagactgccagttgcctaccaaatatctattcttcccttccttagcaacagtaccccagttcttttcaggaaagcaatgtccctgtaggaaacattggccagttttcctttgagccagatgtggctggtgactacataagtgttgtggacttccaggaagcggggctggtttggtgagtaggggcagcagtggcagaacttccccaactcccacctcctggtgcctggaatgcagctgtgatggctggaactccctggaactccagcctaggtcttttctcttccttcccctagcccctcaatagcctactaggagacagttctccttctcaaagagaaagtgtctacttgacagttgatggaacagttgttactggtttccctgaaatagctcttcggtcaattcccttgcctcacctcatctaataaacatgaaaactgacccttaataagcattttccactttgctggcagtgtactaagtatattccatatattatctcaaataaatcttatcccagtgaagtaagttgtgttattatccccatttcggacaaatataaaggctaagatagattaggcagctggccctgctgcttggtcatgcagcaggggagctgggatttcagcagaggcctgttggcttctggactgtgccattacactcagctgcctattcatctttactcaagtccctgttaatgtaggtcactcagaggcattaaaacaccaattcatggatttctatcgcccttttctctgttcttattattgatattatacaaatttttcttagcaaaattcttaatttgaccccttgctgaccatgtgatttgattactaaaacgttagttctcagtcctcttccctggcagaaacatctgagggagtagggacaggacggggaagggtcaactcagttcccttaattcagatactttcagcacccctctggcttctgtaaactggctcgtcctgatgccccctaaaggatcctgtctgcctaatgttttttctaggaaaacttatcttaccaatggcccttgcataatgcccctttttcctttcagtggagtaaaggctgggccacctgtaaatggttagtgcactcagggattaactttaatagtaaaaaggtcctaagcattcttaaacaagtgttcagcttacaaaaattgtacgacattacgcttacgtgacaagtgtaatacagttgtttggtttagtaaatgcctaaaggagggtcattggagatgaatttgtagcttcagtaggttctggtaccaagaccagccctcatctgtatgatggcaactgaagactttcaggatattgattaccttaagaaggaatcatttgttaattcactgaccacactaggtcccaccgacccagccttcttgaaactcctttacctcagaattttaccacgccattcttacatagtactatttattcgtgtttttttgtttgtttgtttttctagattggttttgctttaacttggtcttaagcttctggaggatataaaatgagtatagtgagtttgttttcacactactataaagaactacctgagactgggtaatttttaaagaaaataggtttaattgactcacacttcagcatgggtggggaggcctcagaaaacttagaatcatggcagaaggtaaaggggaagcagggcatgtctcacatgtggcaggagagagagcatgtgtgaatgaggtggggaggtgccacacttgaaaaccatcagatcttgtgagaaatcactatcacgagaacacaagggaaatctgcccccattatccagttaccccccaccaggcccctcctctggcgtatggggattacaattggagatgagacttgggaacacagagccaatatcagtgagtctcatcaaatacacgtgtgggggaggaaaagggaagaggggaaggaggaggatagggaccaatttaaaaagcatggtgtagcatcctgccactgccagcaaggagcatatgcccccagggaatgtctgggtctggcgtcctcagtgggcctcagtactgtacagtcatgtacatatgccacatgcactgcgctgccccgatggtgctctaaggaactgactataagcaaactttagtatctagcccctagcataatatgtgatttcccccgaattcaatacttaatacttgagtgagcctgattcccaggtgaaaacgctgatgaatgcagaggcatagattagggtattaggcagctacatcttaagaatttaagaacagtggtactcattcagcttaaaaagctgcttctgtggaatttgcatgatttctctttcatggacatactcactggtgggctacaactgttggcattaaaaatccagcaccaaaatctagatgagatgctttcatcatctaaatctcaaaacactgaatacgagataaaattacacaaataagtctttaaaactttctcagagaaaaattataacaaggatttcaaaagattctgaagggaaataaaggcaagtatgatacaaaatccgtctaatagtatataagtaaaatcccaagatatcatatctatctatgacatctctctctccatatctacatctaattttaaccaaaagaaatctccttgggaataagtctgattaatggcttctaaaaatgactgaggaaatatttcctcctgaatttccttattcagtctttactcattactctcaaaataacacaataggagcctaaagaagctaaatgacctatttcttcagagaatccatttcttaaagggaaaatgaaatattcccacttcaggtggaatcacatttatataacctgtgcattttttttgaagtgtattgagtaaagtgagcgcttttttgttttggtaagttttttttttctttttttttgtaaatggaatcattttaagtatgctgagagcttactatcttaaaggaacacttaaatcctttcataatgaaaattgagtatattaaatgtgtgtgcttgcatacacgagcgcacacacacacttaagtgactgttagttcagtgccaaaagacttacagaaacagggatttaagcatactaggcatccagaaaaggttatggggatctacaaagcgcctacttgggagaaaatgttgtgtttcttgtggtaacataagtgaatgcatagaacaaaccgttttagagcaccgccaggctattatagagggttaagtgcaggagtaaatgattcagacaaggactcctcaccctgtggccaggtagtcacaaggcggggatcctttaaaaaggtaagctctgcagcactttgagaggccgaggtgggcaatctcgaggtcaggagatccagaccatactggctaacgtggtgaaacctggtctctacttaaaaatacaaaaaaattagcggggcctagtggtaggtacctgtagtcccagctgctcaggaggctgaggcaggagaatggcgtgaacccaggaggcagagcttgcagtgagccgagatcgtgccactgcactccagcctgggtgacagagcaagactccatctcaaaaaaaaaaaaaaaaaaaaaaaaactgtgatcttgtaggtctaaggttgagtctgaggagctgtatttattataataagccccacctgttgaggatggatgctgctggtctgaagaccatactttgagtagcaaggggccagtatagacaataacagccatcggagttcaaaggagagaaatgaatatggtctggccttgagacctctctcaaacctaaccatgtcttctagtaatacgaatcctgtcttaatctgcttaggatacaccttaaacaaattaagtcatgatttcatacacaggtatatatcggatggagggtttggtttcagaccactgcaataaagcgagtcacacaaatattttggtttcctagtgcatgtaaagtcatgtttatattgtagtctactaagtgtgcaatagcattatgcctaacaacatgtagaaaacttctttattgtaaaaaaaaaaaaatgctagcaatagttgaggcttcagctaaggtctttgggaagtggttggtttctagtgagactgtactgtggaaaggcagcctgtgtagaggttataagcaccagctttagaatctgactgctagggtataaatcctgtctctaccacttatcagccatgtaatcttgggcaagttacttgacttctctgggcttcagtgtcattgatagattttttttaatccttatgccaatagcacattgtcttaatttagctttatattaaatcaagatttaatatagtgtgagtcctctaagttcattgtttttcaaggttttagttttttaaaaaacctattctaggacccttgtacttcaatataagtgtctggatcagtttgtcaatttctataaaaaagcttgttggaatttcgattaggattgcaatgaagcaatttgaggaggtttggtaccttaacaataattgagtttttcaatccataaacataatatctcttcttgtctttaatttttctatgtagtattttatagtttatttatttatttattttgtcagatggagtctcgccctgttgcccaggctggagtgcagtggcaccatctcggctcactgcaacctctgcctcccgggttcaagtgcttctcctgcctcagcctcctgagtagctgggattataggtgcgcaccaccatgcctggctaatttatttgtatctttagtagagatggggtttcaccatgtttgccaggctggtctggaactcctgaccttgtgatctgccggcctcagccccctaaagtgctgggattacaggcgtgagcgaccacacccggccattttatagtttttaatgtaaaggagctatacatctttttgttaaacttaagatcttaagtaccttatgttttttgatgctattataagtggcattaaaattgttttccaaaatattgctaccggtacctacaaattgattttcgtatatgatcttgtgtcttgcaaatattgttatactgaattctagtagggtttttattgattaggataataggattttgtaactgtagattaattaggatacacaatatcatctgtgagtagacagttttactacttattttccaatctttataccttttatttattcttgctttattgtactgctaggacctgcaggctaataatgaataaaaataaaaatccttgccttggtcttcatcataaagagaatgcattcagtatttcagcattaaatattttagcttacaggtgtttcatagttgccttttattagattgggaatttccattctattcttaatttgctgacagcatttatcatgaatggatgttggattttgttaaccagcaaatctacatctattgagatgattgtattttttttctgctttattctgctatatattctgctagatttttttgagacggagtcttgttctgtctcccaggctggagtgcagtggcaccatctcggttcactgcaacctctgcctcctgaattcaagtgattctcttgcctcagcctacctagtagctgggactacaggtgtgcaccaccatgcccagctaatttttgtatttttagtagagaaggagttttacaatgttggccaggctggtctcaaactcctgacctcaggtgatctgcctgccccagtctctcaaagtgctgggattacaggcatgagccaccacgcccagcctttattactatttttttttaagatggagcctctggtgtgtggtggcgcgatctccgttcactgcaacctctgactccctgattcaagcgattctcctgcctcagcctcctgagtagctgggattacaggtgcccaccaccacgcccagctaatttttgtatttttagtagagacaggtttcaccatgttggccaggatggtctcgatctcctgacctcgtgattcacccgccttggcctcccaaagtgctgggattaagggcgtgaaccatcgtgcccagctgtgcatggttgctttcatactagcatggcagaattttgtagttgcaacagagaccatatgaccatcaaagagtaaaacgcttactatctgaccctttatagaaggtttgctgaccccttatataatggaaaagaaattgagattggagaggtaaaattagctccaagttttcagaagcagacaaaactcattttgagtctttgctcagtttgttactagatagagctctctgacctttgctagaaattatttaaaaggaaagtgaatgtgaaaatgtccagcaaactggttggtacactttataaagagatttggggtttcggccaggtgtggtggctcacgcctgtaatctgagcaatttgagaggcttgaggcaggtggatcatgaggtcaggagattgagaccatcctggccaacatggtgaaaccccgtctctactaaaattacaaaaattagctgggtgtggtggcacacgcctgtaatcccagctactcgggaggctgaggcagaagaatcgcttgaacccaggaggtagaggttgcagtgagccgagatcacactactgcactccagcctgacatgccatgcaaccatttgatttcttattttgtttgctctggaggagttggattgaatgaggtcccttaaagggtcaaatagctcagatgtagatgttaaaggtatcccccactgttccatcagattggaaggtgatcctcaaatgacgcttgaattcaggaataaactttagccacacacacgtacatacacacatataaatatatgtatatatattttggggtacctattttcaatataaggactcttaagcatcaaacatatcctaaaataatcggtcttcagagacccctcccacacagatgcttttatttttcccaaaacaagcatgaattgacttagaggctggctcaaagatataacggcaccctccagcatggtgaatgcactcaagagggcattgtcccttaccacagcttccattccttgcacctggctccaacccctaggacatcagatacttggatgggtagatggatgaaccaccattctggatagtaattttcgtggttcccaagcagcttttttactctcagtggatgaaaaccaatacgggggaagagaagggaggcagaggtgttacttacctctgtataatagacatgtaggatcctcaactccagcccaggtagactcttattggggattaaatttgatctaacatgtgacgtctctggaacaggagctggtaaatggcagactccaatttcattaggggtcaaggagctagaataaagttacccttcatgttatctgtttccttgaattttcttagccctggacattaaattctgttctttaaaagtcgctcattgaggccgggtgcagtggctcacctctgtaatcccagcattttgggaggctgaggcgggctgatcatgaggtcaggagattgagaccatcctggctaatacagtgaaaccccgtctctactaaaaatacaaaaaatcagccgggcatggtggtgggcgcctgtagtcccagatcctcgggaggctggggcaggagagtgaatccgggaggtggagcttgcagtgagccgagatctcaccactgcattccagcctgggctacagagcgagactctgtctcaaaagaaaaaaaaaaaaaaaggtttctcattggaattgaaaatttcttcctatgacgtgtctgagaatatgaagtaatgaaaagtgggctgggtcagccttggcctgaagtgatgcttacatgaattaaccatctctggagggatactcgtgtcaaagtaggagtttattcatgcttgactctccagtgtgatgtctgggattgcttgcgccagctctgaggagggcgtgcttgtctttctttgtgaaataatagaatatggatgaatccgtttccccatgaaaccatttctgttgaactaaaatacaaaggaaaatcggtgaccttgaattaggcttgtttgcagtgttattagctttcaaaggccctttcatttccatttaatgattttcttctgaacaaactattgtaagaacctaatgcaatttttcaaaaccaacatcacaaacgtggttattattttgtagctaatttggttagaaaactatgaggccctatgtattaaaacgtcatgccatcacttctcagaatggcacttttaaaaactggattttagtcttctggataacgatttcttgaactactgttatcaagaataagtggtatttttcatgatctttcttgtctggagagttcgtgacaggaattttgtgcatgaaggatgcctgtgttgttgaatgtgttcttgcatccatcttgctcttactcagatgtctgaagctatacatgtcaacttactcattcaacatgtatttataaaagtgtccattataggctaggcacggtgctgttctgggggtcatcaatggaaaaaacagactataaaatccctgccctcctgtagctaacattcttttaaaatactgatggcagaattttaaaacactgatggcagaattggaaagaatgcccccgatacaagcaagaatgaaatacagtttttattttctgcatctaaaaatcacaataagtaacttacctcgtacttctaagagtttgaatttttttaacttggtaataattttagtaggcagggtgcagtgactcacgcctctaagcccagcactttgggaggctgaggcgggcagatcgcttgagcccaggagtttgagacaagcctggtcaacatggtcaaaccccatctctacaaaaaaataaaaaaattagccagacatagtggcatgtgcctatggtcccagctactcgagaggctgagatgggaggatcactgagccctgggaaggtcgaggctgtcatcatgccactgcacttcagcctgggcaacagagtgagaccctgtctcatactactactactactactactactactactactactactactactactgctactactactactaccaataataataataatttagttgctctgataaaaggccatgttactttacttatggctactatttgagtgcccactgtgtctcacaccctgtgctgagcgttcccatttaccccatttggcagatgaaaactacagcatgttctcaactcagtagagagacacactcttacacatggaatcttaaaaaggttttaattagtcacttacaccaagttctgtgatagttccacagtgactgaatccaaactgcgcagaattgagagtagtgggcaagagtcaacgatgggtttccagttctgggaacttgggagactggggtgaaacaggtcccctctttcctgcccacttactcctccaaacaccaacttgctggatgaaatattacatatgatcctcattgaaagagaaaaaacttggaaagagaacagaagggagaggaaaaagatgaaactgaaggggaagggagttgttcttaaccacaagagcaaaacaaaagccagagctccgtgtgagctgccatagtgtggtgtctgtagtttctgtatggccaggaagtgcccttggaagcaagtttcatgaacataaatgatcaaagccaactaaactggtcaattagtcaaacttggcttccttagaaaagaataggacctcaatttagccctatttgtcagctagaggagtcaatgcaattgaggggtaaggggttgacagtggtaataaatcattgggcttttttctcggctgtatctttgcctcataccttcgtcaagccaccctagaccctcctctagcagctccaagccccttttgtttgttgtcacttctatttaagcctttgccttaggtaccaattagtgaagtgattatcttaaagttgccattgtcaatgctttggagaacgccttgcattttgaccaagctggtgagggaattgttaagttaaagatgaactctgcatgattaaggtatcaaaacggcttgaagactgccattttaatgcacctttcacaaggctgtgcaactctatacttaaataagtggccagttttgtttttaagtgacgagccacatggagaaaatacttccaggatttcagttttgaaacaattgaaattctcctcctcttagagtgttagctcctgtgtgtgtgaaatacagctggtcacctctccctgtggtgctgactctccactcacggaccgggcaccatctgagatgtttgacagaacattctgaggaaatggaaatgatgaaatcacattgaattcaacagtagaatgataggccatttaatgcagccttaatcttgtggctcagttggtgtggtgtaatattaggcttgcattctaccttccaaatcccttgatagtataaactagcaaattaagacttaccctgaaaatgactgtgtgctacactacaagaaaggtagaatgctccaggagcagtacagatagaggtagtaacattttgccatctggcaaagccactagaccagatggattcattaatgacttctctaaagtatttaatcagacattactgaaacacatgactggcatatttaattatcctaaattaacaggacttctgccagatacaaccctcaatgcttgagtcatactccttgcttaaagagaggaggaaaaaaggatgactagctccagaaagctggatttcacatagacctctctcattagtgaaacttctcattagcaaattgttgtgttacagtcttaggcagtatttcttctttttcaaagaatgcactgtaagactagccatgctgatcaaattcttttatcagtagcaattatactggtgagaacctctgcgagttgataaatgtgacatagccatcagacaaccctgcccacttcctgcctgtggaagacttctaaaccaacagatgccttcttgtgtcagttaatcaatttatatttctccaggatcacttttgttttaatctttgtatttgtatcagaacaatggagacacaaaataacagaaagcattataatgtaaatttgcccctgctctagtctttcctatctgcaatctacttttcaaaggaacacttctaattttcaggactgttctctctggtggttacttccacatctcaaaacagtatggttaatggctatttcttattttctttagacatgttgacttccttttaacatacatgaggatgtagcttaggtataccattcttacatcacttttcttctcctccctgagggttattttattttttattcccttaacgtttacctttgtagctttaggttatattttcatacctttttatttttgggattgtcaactagaaacagtatgtcttggctcctaacatatgttgaaggtattagtgacttgagtattccactgaatgctccagagttctttcactcaatgtaatatttttgagattcatccatgctgtggatgtcactagttccatttctgtttatggctgagaacaattccattgcatgaatagatgataatctatccattcacttgttgtacgtgtgacctatttccgatttctggctcttttaaatctgtgaagacttgtatgcaagtctttgtttagacatttccttttggtttcccttggataaattctgaagagtggaattgctagatcataatggtacgcatatgtttataagcaactgccaaaagacttttcaaagtgatttatcattttacatttcctattagcaatatatatgcattccagttgccctgtgtctttagcaacacttggtattatcagtctttttaattttagttgtccttaacattgttcaagtcttccagcatattttaaattaagttgtgttcttattaaattataagcatttttatatattctgggtagaactttggtgattttgttgtttttttcttttcattctcctagtctgtgttttgcattttcattttcctaatagtgtctatcaaagaccagaagtttttatttttaaagtccaatttctcctttgtgtaatggttcatgcttgtttgttctctaagagaccattatctttcagaggtcacaaagattttcttatatttttttctatcaattacttggtttagctcttatactttttgagtttttttgcatatggtaaaagggaagagtaaggttcacttttttccatatggatacctagttgttccagcactgtctgttgaaaaacaatcctttcccctgatgagttatcttaacacttttgctggaaatgagttgatcatataaatgtgggtctctctatggattcaattctataccattgatttgtatgtctatccttatagcaatattctgtcttaattccttttaataaagactttaagcagaacttctacttttgttaacattttttctgacatatacatgtatgtatatacatatatatgtgtgtatgtatatatacatgtatgtatatatgtctatattttagatcttttctccttagggaggcatcttcagataactgatcttgtccattccaaatggtttttaccagtttaaatcacagagaatagtcttatttttaaattcaaggagagttcaccatagctctctatgtacatgagttgctcggacttagaatgtctgttcctggccgggcgcggtggctcacacttgtaatcccagcattttgggaggctgaggtcggtggatcacctgaggtcagatattcgagaccagcctggccaacagggcgaaaccctgtctctactaaaaatatagaaaatagctgggcgtggtagcacgtgcctgtaatcccaactactcgggatgctgaggcaggagaatcgcttgaacctgggaggcggaggttgcagtgagctgagatcacgcccttgcactccagcctgggcaacaagagtgactccgtctccaaaaaaaaaaaaaaaaaaaaaaaaaaaaaaaagaatgtccgtttctgggggtgaggggtaggtttcatgtgggtctatcacatggtggttaattaataacaataccacctatatagtgctaggttttaagtgctactgttttaatcactgctttaggatttattaagtactcatagtacctactttctttgaggtaggtactgttgttattcccattcttatggatgagaaactggggcacagagaggttgagtaatttgctgaaggtgatatatgagaaactgttctttgccagtaagtagaggagacaggtttcagtgatgcacttgtcacggaacaaacagctctccaggagaaaaaaaactatgcatacgcattaataaacttatacactttactgacataaataatatataatgcacaacttacaaataataaagtgtcatactttttattccacatggccaatcaattctgatagaatgcttttattgattttttttttcctctttttctaaactcctatatctgtggtcagtctatggttgcagtttaagcatgacttgacaaaatcaaatgaggaataaattcttgattaccatctggttcagcaaagaagttgttcacatcattggcaaatgattaaagttccaatatgtatatgttttacattttccttattaatgtaaataaagctatcagccaacatttgtgttggaactacacttgttggtcagtgatgtgagagaatattgaggacgttttctcaattttatatattcacaatgtaacagctacagagtgacacgcttttatgtttattctgcattatcaacattttatcctatctcttaagtctagacaatcaacaaaacaataaattaagccctgatttgtagcacttagtgatttccatgatgtaaatatacccactatggctgacttcaagccaccaatgtgacatcattgaaaatggagttgggaagaggtgtggagtaacacaccatctatggtatttctaccatatggataggatagcaataaataacctcacaactatagacaacagtgaaatgtagtaaaataattaccaagtgacgagctttcagtatgtattacctttgcttttaatataatttatgtaattgtaaatcaatataatacctaacagtggctgtgattaactggtttacaaagttgctaaaacttaatcagtttttggtggccagtctaagctggctccaatcatgccactgtatggctgtatttttaaccattcttttatacgaaggtattgctggaatatagtttcataccagtaagtatagcatacagttatggcaaggtattaagtttattttactaaatcacattctcattagatgcaccactcatcaagcttgttaaagtccagttttagggaccccccctgcttaactatggattatacgggttctgtggggttcacacaattcaggaaaatggcaatgaattttgctgttttgtccatgttgctgtcattcctgtttgtgctgcccaagcccaccaggaaggcagggccctctctgtggtgtcaagatcacagttgtggtggggtactgaagtgctaagcgcatctcttgggaccaggactggaacacagccatccccatctgaggttccactacctccaggccactgttcaaatcaggcctgcctttgccttttctgccttgcagatgaacatccactgaggttgggtcactcccccttcaatccccaaagcagcaacctccccttctgtcgtcagacaatgcaacctaattttgatgtgcctctgcctctgacatggaaaagctgctctcaaggttatcttcagggcagggagggagaaggctttcatgctttcctggtgagactttttttttttccaaaaacaaaacaaaaacaaaaaaaactaaacatataaattattactgagagaatcactgaagcagcctgggcaaaaatgaaatgaggcttaagaattgtgaacattttttaaatgctgcacttggaacaagtgctcataaaattttttgcctcaaggaatcaagaatgattaatattgatgagtgttttgttgttgttgttaaacttcataagcaaggctgtttccttccatgacccttttgattctcatcttttctttttcacaagatgtttggaaatcttcgtgatcttatctgacatcaggaagacatgcttttccctcctggcatgctagagaaacaaatcaatttcttctcccagataggttgatgaaagtccttctctgcagtgctttctattgctatggtaacagaagatgggatttcccaacagaactaggtttatatattaaaaaacagttctttcaaaacttgatcctttttttgttgccatatataaaatacaataaatggaataaactgagtaccaaaggaaaaacagtcacaccaaaactttttatgtaggtgtggaatgagactttcattgtcttgagactcgcaatgaaagggagtcaactgtaaaagttttaatattgtgacagtgctgtcgtagctaaaataacttgcaaaagttgcaagtcttcttagaaaagcaaagaattaaatatatggactctcaataggcagatagacttaaaatagagataagtagtgtccatacttccagtcataacatggtaaagaagatgacaagaagcccaaggtagaataagcattttgtgtgatggtggcactctccgcttctgtgacttgcgctatgggaggacacaatagttggccatttctcatgagatcttatcaaaagcccagggattcaggggacagggttctttgcatcacagtccctcaattatatgcaaagacctgaccttttaatctgctggttgactaacagcatggctggagggtgacttctgaggctcagagcactcagaaaggagcagagagcaattgtgaggtaggtagaaaaggatggacttggtttcatttggggaaaattcaaacataatacttccctgtcatttaaaatgcttctgaactaaaattccaaagatgtgtggaattttatttattaaataaatacttattaaataaatctgtaactccaccattattgataccttctattctcttgcaaatctagtgagtaaagttcgtgagcttttctccttttttgaggcttaacgtgcttttgaaatgacatgacaaatttaaaatagaagtaaatgccatttggctgtgccctggatgagacatggatgccatttggctgtgccctggatgatacatgtcactgctgaaaggggtggagtttctgggaagcctgatgggaaaggtaacaaatagtaaagtgaataaaggtggttctctgttcttgctattcttgacatggacatagataaatggtaacattatgagtcactctaagcaatcatgttacatcaagccagagaggtgatgtcacagactctggctcatgaaaggagaaaaagctcattttcttaatgtacccaaatggcaaaggaggactggagaaagggctgtaaagagatgatttaacaaacagtgtgaaggaacttctggcaagaaaaaaaaattgcaatgtgaactttttagtaaatgtggtaaatttatgggcttcaatatgaatgagaagaacaataaccagcataaaaatactttaaatccaaaatgtgaggtgttttggggtagcactgcttattgagtaactaaggctcgtaagttatttgaagacttgttgaaatctgtttattccattccccccaaccccgtcattcaaagaactgcaataaatcaggaattatggaattagaacaactgctcggagcagtgatttattatttgcttctggatgcttcagaatctcaagaatctaacaagtatctcaaggattttaaaatagaagctgtgatcacagcaaaatagtataatttatatctcttgaaagtgtttctggccttccaggggaaatatgctcattcttcattttctagtccctgggtagaacctcttgcctattgcagggggagaggcaatatggcagccaagatggttggcagcattcactccctcttcaagtattttgttaatgcctactctgctgtatgatgttccaggaactgtttagagtgatggaagacagcccctgccctcacggagcatacaatctagtcaatcctcttcttcctagcctttaggactccagatgtgatgctaacctgagcagtctccttggtttccccactaaaaattggatagttaggccatcttttcccaggatcaggctcataggcttcaaactttactgtagccaggctctgtgagttacaaaccttgttgcccgcacaaaatcttctgtcaactttaatgtgcccaagcttgtccttgagtctcaaacatactaagcatttccccctctgttctcacccccagtagctcttgactcttctttatcccctctacccatgtcttccctccctgtctctccctggtccctaactgaccaccttgcctctcctaacacccctcacagatctgtccttacccctgcatttcatcactgctaggattaccttcctaaattatggaactgtttatgctgtgtcctgctgaaaatagtcagtggtaccctaatttcctggcctggctaaggcagctttcaagagctgcccctgcctgcctgacccatctcattttctgccattctctgtaagactgaaactgtggaggacattgtcttttcacgtgaatcccctttgcaccttgtctttcatatgaactcgtgtcttccctaatgtcctgggcagctggtcactccatcctccatctttctccatcctccatctttctgtgttactgtgtatgtatattgacatatcgtgattatttctttacatgtctctttcctctgaaagtgggctccttcaaagatagcagtgtgatttctgtttatatgtctatggtactgtccctgacatatcataggtccacaagggcctgttgaataagtgaatgagctaaaatatactggtttatcaacagggttttcaaactgcttccatccactcagcttaatgagcaaacatggcatgccataatcttgcagttttctgggacatctaggtactttgaaataccaggtgtgtctcaacaaaattgagattgggagggtcctttcttattgataatctctcaccaactgaatgctgaagtgttctacaaccttaaaaagttaaaagcttatagcattcacctgttgtgaaaagcaacccttctatatgggctatctttttgtattacttgcttatgaagattcctgaagatatattttccagcaagcacttttcagatgtccaacatggatttaaagtacatatgttgtttttggaagccatattatattcacacaggcatgtttatgttggttatagatatataatgctgattacacaaaagacaaaatttgtattcagtgttcgctctgtaccgggcactctgctaagtactctagattgactatatcatctattttctgtattatctgtatttttagatgaggaaactgaggcaaaagatgaagtaatttgtccaaagaaccagagatactaagggcagccaacatgcaaatccagtgtctgatatcagaacatatactctcattaacaccatgccaaacactgaaaaaaaaaaaaagtctacttccatttactgtgttaagcagatactgaaaattggaatgggaaaatttgtatttgttgattgtataagcagaagtttacacaatgagctagtttgctatataggtaatgtgctcttgattcccaacgtctgttttttagaaagacacaacgcctatacacaatgaatttaaaacattagggtgattttttttttttaatctaggaaaaatacttctcaacggctactgactccttaaaataccagttggtatttgacgaagtttcatttttatcgaactacagagaaaaattgctatacaaaccacaattgtaatttgtagttctttggtgtcacagtgatctatgtaaaatggaaactttaacttaaaatttgtaatctatagcaacagacacagaaacagcacatgactctgggacccattcatgctttgaaatcctaatgaggatagtatctagtgcttctgcaagtatgtttaattccaagaagagaaccttcccctagtaacaacatttaaaaaaaaattaaagtcaaaagctaacttgaaaacaagtaatattttgaatatcaataattaaatttcacaacataaagcaattataaaactatacagacgattttaaattgaataattacaatcacaacagcacctaattttcaaggtaaccaatgggtaagaccaaatgagattgtcagactgtgctaagcctctctgctaaagtgaacatttcaattagtcaaatcaagtaattaattactttggggacagttcagactctttctcttgagatcaccttgttagataatttaaatgagaaacagatttggataaaaggtgatcagtgttttcttcagttggaagatgtgaaaagaaaccttttctctttcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacaggtgtgtatctttttttagttgttttatttaatgacttctcacaactcacttaaaactataataggaatagccagtagattcaaagtccatcaacccttgctggttcttctggcacagcctcctagaatttttcacctgttttttcccctttaaagctatggcactaacaccaaactctggacaggccttggtttttgttcccctagtcccaccatctggttaaaaagcatccataaaagaagtcatgaattcatggtgatcaggttcaccatagcccagtaattctactttgttgtctgttgttagcttcctatttggagtaagggctagaccaagccttattcatagacgtcaagccctgagcatgtctgtagtacctcttgctttcaaaagatgacatcacctcctaataatccactgagaagattatccttgactctttaccccttgatgtcacttttagctgcttctacctgtcctctcccaattcagtctatcatcaattcctgggtattcatgtttctttacagtaactgacatcctctcctttccattcttcctgccactgtcctttaagtgctaataagtcagtgtcatgtctgacttagttgaatctcttagtctcctcacaggcaatttcttgctaatgcatttcatcaactgaaaacggtgtgaaagcattgtttaaaaccaataagagcttggagtactcaatgaataaagtccacactttgtaggtgggcattctattttagccaacttttctagacttttatccgttgtgccctcatagtcgaattggacaaatctgcaagactcctatagcagaccttgcatgtttgtacctctgggccctgcctcagtctgtcctgtccacctgaagtgtcctgctcacccttttgcccattgaagtgattcagtctccaaaggttttcacaaagccttgccaatccctcccaacaacattttctcttcttcctttgacttacagcaacactgggcagaaaagataggttgatacgttctagaaaagaaagtaaaaacggaggggtcattcctggctccggctgcattcatctcctccctaaggcggggcctcttctcctcatctccccaaccgcctccgtttcctgtgccacccttcctctgtctctctcaccctgcgtgtttctgcctgttaattccttcaatctaatttttgacaagtttcagagttaattctgtaagttggtgccatgcaaagatctgtgaaattattcatagaggcttaactgaaagtctgtgggaaattcagtggattataggagttgacctgggttgagtcacttttgaaaaacaattagcatttacttgctgttttctgctattttaagagagcatcgatcactagtcatttttctttctagaactagatttattacatatgtagacccctggaatatatgttctttattttactcctttgtaatctcatccagttagtcagtttaatgcatgcattcccttttatggctacataaagagataatagctggatgctagtatttgttcaggcttgcagttatattgacttcctgaataaactgaagtgaatcagaatccatacacatgtacaagtataaatgtatgcttatgtctgtactggtatgcaccttctctaatcggattttgttattcaagcaagcattctttatcaatttgttctgaagtgtcacaagaaaatgtaatgcagcagaggaaaatccagctttaaaaatccagctttaacttcatttttgtccatgttaatttatgttagaatcctagctattctcctttaggtttcattttgaaggatggtgggtgggggtggattgcatggtacttaactgtcaggtgagagaaataacctcttgtatgttagccatggtggatttcctggcttgttgatggctatttcttcaggtcctccttactccctggacagagttcactggaatcgaatgatatttagaaatgacaaatggtccatcacctcacaatagacaaaaggcaataaaaatgcttttcaggtagctatgggaactgtcactacagatgaacaaaataggtttctttcagctttttctccatcaggaaatgtgggttttacttcagtgcccctatttgtgttcactgctttttttctcttgaataagctgaatggaattcacccattcagattttcttatgaataaaaatacaaccacatcttgtttccattgctgaaaccctcagttaaaaaattatagcaaagaaatttcttaaggacacattaaaaaaccctcaacgatgtgtgttatattaaaaattcctaatggaagccatctttagtgaagaaagctgaagaatccctgcataacagcacatgtatacatttaaccatatgtggctgtctgtttcatccacactgtgagtgtgcatatacacagacacactctcgaatgtactcagtactcacacactcttacacttggggaataccatatttttaaaacccctttaatttacatacttcacttgacccatacaacaatccaataatgcagaaggaatgattattttttatacccattgtacaaatgagaaaagtgagatttaaggaggttaattttgcaaggtgttatgtctggctacttaaaagcaaaaagaaaagccaaatctacttatagttcagatttcttacataatactttctccttataagtgatatcctgcaagaaactctgattttggtatgactgttgcctgtttttcacacttttggttttgtatataatcatgtgggttgcattttattcttactttaaggacaggttctgacctgaacccagggaatttaggctgggaggtgaagtaccagattacttctacttagattatattatcttgtagtcaccttaaatgtttgtgaaattatagaaaactaaaaattaatgttcatttattctattcgtcaaacccttaaattttagcagttggaagcttttagactatagaattctgggttctattaaatctcacattaagattttacctaaaaattttaagttaaaaattccaaatgctgctatcaagttctgtttctgtagtttctattgacgtttcagagatctcctgagagtttatatgtatgtttcttacacttaaaaaggataaaggagctgtagctcttaggttcttgaaatttcagcatatactaatggaagtcatcatctattgtgttatttttagtttggggtttaagatgggttttgagaaatcggtttgttataagaaattcaatgcctaacccatagtaaatagtaactatttcttaacgtgtcagtaagtcttcccatcacttttaggtactaaattattgttcttattcttagcgtttagcctctgtggggttggatgccaaaaacacagtctgcatttgggactggaggaagggaaaacttctggcgtcagccaccggccattctgacagggtaagaacttgttggatcaagctatgcagatttcagaacttggggggacttgtgatatcgcgtctcagacttctaatgtttttaacagtaaatatttcagtatacattttttcctattaaacttataatcatcctcttttttcatgattaatagctaactgtgttaatgtgcttctggtgatcaagtactttatatgaattgttagtgcttttcataggcaaagcaaatttttgatgctggcattttactttatgaaatcaaaatggaattgaatttgaaattatgtgtagtttagatgtattcatttagaaatggaaatagttgttagaaaatagtcacaaaatatgattacaagggtatgcattttaattttgaatgagtgtaatgacaacttcgtgattctttgttgtatttgagaacatagaatgtgacctgcttactcctgttgaagtcagtgtgatcaaaaatgataattccatgtagtcttaggggatgaagggggtatatacatataactggtcagaaatctaatttgccagtgtcttgcataattaaaataatttgactcctttattatcttggtttctctaaacaatgaatttgcatgactgtcttacttgaattcctagttgttttgtatttctgcacaatataagtgttaatgtagaataggcatttccagtcttttggcttccctgggccacattggaagaattgtcttgggccacacataaacaccaacactaatgatagctgatgagctaaaaataaaataatctcataatatcttaagaacgtttacaaatttgtgttgggccgcattcacagccatcctgggctgtgggttggacaagcttcatgtagaatgaggctctaattaaacatgaaattcactgtctcttgcttagaaggaactcttaaaaaaaaaaaagtatgaatggcacattgatctatggaggtttgtagttgtaaggagaccccacagatgttgcaaattctactccaggatcaagtcttcagaaagctcaggagtgaccaacaatagaacctcagtactggaagaggcctggtacccctctcgtccagtagttcccaatcctggctacagatagaatcctctggggagacttcacggcatatatatacactcatacataatattttatctgagttactctgcatttactgcttctatttctgagtcattttatatagtctgacctgaactagtatactgtctgtcagaattttgggccttatcaccttggaaaaagtagaaaactaaagttacaaacagtttaaaccagtaaaatctccttacttagaaaaatagcctaatgtaatcactttggcttgtatagaaagagcttttattgttaaattattactgttaaactaaatttggcctcagctgccctccatatggtaagtctctacaaaatcaactgcaacctagcttgctaagtgaccaaactgaaaatttaggggtatacttccgtaacaaatagctgagtggcagccagcttcagccaatggcaggctgccatctattcagaccatgcccaaataaagcaaattcggtgctgaaactaggaaagctgttcctgtacctcagttcattttccccaggatacatatgcctgcccagttgcagagcagagctctctgaacctcttctggttctgagggctgcccaatttgcaaacagttgtttgctcaattcaactctgttaaaactttagataaattgaacacctctggatatcatgtgacttgcctgtatgtttcagtgactgtgcatgtgctattgctgtgctaccgcttgccagtaagggtgaaatgtaaaaagtataataggactatagtgatgagtctgtaatcttaggatgttttaatgaaatgctttatttggaacactgttctcccagaccccataatctgtgtcacacataattttgctctttattactgataccagtatgaattattgactgcttatgattaacttcaagattatcctcaagattattttagtggcactaaaatacttaatccattacatttatataatgaatgttttataccctgcaaaatgactttatataccttatcttcattgaccttaacaaaacttgaggtggtattatccacgtagagaagatgaggttaaggttagagatgctcagacttgcctgagcttgaatggctgaaatggatacttggaccaagtactttttcttcagtgatctttctggggaccataattgctcctttatatgtgatgaaaagttagtggtctaggttatttctctggtctagactttgtccctgacaagtagtccttccctttctatcagtgtgtcatggaatgcgttccatggatctacctccatcagaatctcctggagtctctttaaagtgttgggtatctgggcccaattccagacccactaaatgagagcatctcagatgggccctggaaatacctgttttaagcaattgctatgggcaatttgattctcaggattgaccttttccttcttgtctctggattggaaatagaactacgtgcaaactgtctggtagctcttgttaaagaatgacaaataggccgggcacggtggctcatgcctgtaatcccagcactttgagaggccaaggcaggtggatcacgaggtcacaagattgagaccagcctgaccaacatggtgaaaccccgtctctactaaaaatagaaaaattaactgggcgtggtggcacgcgcctgtagtcccagctactcgggaggctgaggcaggagaattgcttgaacctgggaagcggagttgcagtgagccgagatcacgccactgcactccagcctggtgacggagcgagactgtctcagaaaaaaaaaaaaaaaaagacaaatagtagttgcagatatattttcagttcattggataattgaaaatacaatagtatgttgggtcagattaaaatgatagcctgagggactatttaagttagtgacagataaatccctctgccttacgtttaggaatattaacttctgtgattactagagactgttggccgcattaaattgtagttaactattgaatgttttcctagctaagaagcattttataattctttaaatttctattgaaaagctatctccaaagtgttagcactgtggagtgctattgaaaaatttgatcaaaaatttatcctaaattgtccatttgtttatctcaaatggacaaaattaaaaatatgacaccagtttgttctaaataattatggtaagttctctctctactcaggccttaaggtaagtagatatgaggtgataacgtgtgtgttagttcctgactcattccaagccaaatcttccatttttattctgtgcaggtaacattgtgttctaaatgttatagtagagtcttggcaattggactagtattgggaaaaggcaaaaatataccaaatgatcaacatggcaacttttaatgttttgaacagatttttgatatttcctgggatccatatcagccaaacagagtggttagctgtggagtaaaacacataaaggtaaagctttttgttttttaattttggtaccttgagtgcaaataattttaggtgtttgtatagataatttgatgttgagagactgctagactttacattttttttcttcaatatagagccctcttacctgtttctctgctcctgaagcaaactaacatcagctgatggggctctctcttagaaatgcaaagtaatgacaatcaagtgaagtgctccgcaggcagctgaaaaggaaattttatgttaattaaatatcgaactgaagactcataatacttgtgggattgcatgttttaaaacagtgcttattttaatgttgtgaagtaagtttttccattataatgaatatttacatatttgcatgtcaacactttgacatgttatgttcccttaaaagaaaggtgtcaagttgtgctctacatggaaatagaggaattcacagtacaaacctatctggaccattggtttttaaacgccccaatcttcctctagactacactctcatctgggtagacctacatttgcttcttactattttgttcacaagtaacaaaattaactgcatcaacatgctttgctctgacatagcaaaaatttctcctgacccctgggatatagcccaggatcttctttctctataggatcgtaaataatgtaagttaaagtccataaacaagagtataaggattactttcttgaatagagcatgcatggattctgtacaaaaatggtacatttctgtatgaatgaagattttcctctaaccaacccctcctattttgcagttcttttagtctagtttttcacgatccttcccattagtcttacttggttagaaggggacagaggataaaatactcaaataagtataagaaatatggaagacttacctaaagaatgttacaaaactctgcagaagaatgtaaaacaatacttgaacaaatggagtgacaatgttgattctggacacgtctaaaatttacaaatgtatcatttatctccaaatttatatttggtagaaatgcagttaaaatccctattacttttgtttttacctgacagaatttccctttaaattatcctaaattaatccggaagcattaaataatgacaataactatgaactttgggataaagaatcatgaagaggatatatgtaccactatttactaaagcataatagaatttaatttaaatgatacaagacttggatacaaagaaataaaaaaagctgaaaaatagaccttaatatgtatgacaacttagagtataatagcatctctaactggcaggcacaaatttatcaattttttagaaaaagtcaatacttcatactatacactaaaacaaagtctatatgaattaaagaggtaagtttcaaaaactataaaataactagaggaatatataggcaaatatttaactgctcaaattggagaaagatttttttaaaatgtaaaagcaaagaaatcgtaaggaataatactgatgcaactgtagaaatattaaaatattctgtataattccttttttccacaaaaagagggaaaccgcaaactagcaaaagtataagcaacacacaaaatagatactgggttgttctcaaaatgcaaagatctcttgcaaatccgtagaatggacaaagaacatagaaaactgacaaatagaaacactgttggccaatagacttatgaaaatgttaaaatctaattaaggaacacaaattttaaaataacagcattttaaatctatcaaatttatgattgaaagtaccgtatcttggcaaggattcagtgaatgaccactctcaaaccttgctggtagagaggggtaagctgataatggtctttcagccaagaaatttggaaatatttatccttagaaatgtcaattctctttgatccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaatttaaaaatggagaacaaaaattttagaggttccactactcaaaagtgtaacatattccatcaacactttagggcttcataaacatttaataatcctgtaccaagccctgatgtgtatatttttaatctaggaaaacatcagctgaaatctaggtagtttgctttattagcagcagctggaggctccttctgtgcttggtacagcatacctgaaagaccaaaaactcattcagtttaatatttgagtttgtactaggtgaaagaagaaaaacagacgccactttcaatttgcttgaagtttagccattaaaacattaagacagaatgttttggaagaaaggtaaaaatcaaagccctctatcgataaagatgacatcccagctggctagaagcatgttgtcaggatggagatgctgcttaggctgagcctcagtgggtgggtgagtttggtaggaagggtcgggaggcagaactaggcgaggggttgcacttctgtcaggagttaagagaggcattggtcacccatggaagtgtgagactggggagctgggtgggtccttggctcatgatatgttccaagattaccaatgttttcatcaccaaagaacctattccatagttttttttagggaacaaatattttgaaagatggcggccacaaaataaactagccaataaatcacgggttccttagcaatgttttattagtcaaagatgttatctgccaacgtgagtttctgatcagactaaaatatgaaaattgtttcagccatgagtaaaaaaaacatgtgagttcataatgatcctgatttctgttaggctgtggtgggtttctggaaatctgggaccctatcctgggagccatcatccatcctgtactcagtggtgaagaaacccaggaccctagggggttaggtgggaatctgactttgatttgtgattgtttccctctgcttgactctgggcaaccatttaatctccctgaggctgaattaatattcattcattcattctctctctctctctctctctctctctttctgtctctctctctctctctcagagagagatcactacctcctaaattaaagataattacattaaagagtatggaacccagtaggggcacaataatgttaatttcgttccccatttcctagggtcacaaaaatgatggcacaggtgagatttaagctcagcctctgactcctatagagctctttacactgagaaatttctttagtgaactaccttgccttaactttttattgggttctaactagatttgctgcttaattgatagaattctcctgattccttcctatctctttctgtccttggttaactctaacttttaaatcggtaaattctaaaagcagaaaagcagagacaaaattctgaaactttatttgaaacaagagctacttatcctgtttaaatttaattgtcttagcagacttggacattttttctaagcaaatacaagcatttttacctcaaagaatctggaatgtctacccagcaatactttattaattttgcttagaaatataatacatttaagcggacttcaaaaaattatttttgctgtctgtattctctatatccaattaccaggatttctccacttttttttccccagaaaacctaccttaacattgaatgattccagtcataaattgagtgcaaaatctttgtactcaaagaaaatactttcatctgaaatttgtatagctagggtgaaatcctttttggctttgtaaatcccctatgttttggcaaataggaaaattgcaattatctgaaacgaatgcttgaaaaacagtaacagttgagcatcggctgcttcactggttttatagcaaatgagcctaccgggtttgtggatactgttgagccgtctctagtcagagacagaagggacttcagggactacctagggctagatgaactcaaggtacctgccagctctaacaaaatttgcattacagtctgtgggtagagactgcagaagataaacaaggtctcctcatttgatgtgaatttaatgatgtgttgctaccctaaactgccactgttttccaagtaggaaatgcttctcaaaaagagataatatttcaggtatttgccattttctgcagaaaataacatacattttagggaatcatttgactctttggaatgttttcatgtgggccttataccatctgacctggtgacttgtcaataaacttttatgtagatcaagtctgaagataatgggttctattttttgtgactgtctgtctggaaatattcagataactcagacggggggtgtatatccaaagttaaaggacaaaataattattttaatcttcatgcatgaggaggtgtaaagagaaagggaactgtctgccttaagcattgctatgaacagcaagttctttggcatgttggtgcaaccagtaatcatttatgtctaatagtttgttcaggttcatagtaacagcttaaatgttttccaaagcttatacctaactagctttttcctagatctctttattctttattaaaaaaaactttattacaggtgtgtgctaccactccaggctaattatttttgtagagatggggttttgccatgttgcccaggatggtctctaactcctgggctcaagtgatctctctgccttggcttcccaaagtgctggtattacaggcatgagccactgcacctggctgctttattatttcaacatatacttcaacaccttttcattaataatacccaaagaaatgagttaccagagctgatacctttttctgagaagagaatccgatttggtccttcattgtgtatctgcccttcattcttgccaaggcatccctctattccttaaccccctgccacgcacacacataggacagccccccacccccagctgcctgaatcctggccaccttgggggtatagccatcccagaactgtttcctctagtacccaactactctgagaggaccatggtttttcctctcctacaggtgtaaaatagtacaatgttactgatttactcccacatgcctgccatgtggcttcatctcatcctgcttctctgaatccagatgcagtttcttcctcactgctgatccaagtcctactcttgttcattctgtttaattcaacttagttctctacctttgaatttcctgccacccgggcacagtctgaatatgctaccttaaaattatctcattgtttcatttgcctctgcattgattcagagttgtcaaagcaaagacaaagatttcagtattttttctaaccccattgaacccttatcttcagtgagctacttctgtttgctttccctcccctccagatggagatgaccatcctgtctaccttagcctattaaaggttttgataggatcaaataacttagcatatgcaaatagcccttataacctgagggggggctatatcaagggcagtgaggttattctagttgatacatgaaaactatgttaaggttttgagaggccaagtggggcagatcacctgaggtcaggagtttaagaccagcctggccaacatggtgaaaccccatctctactaaaaatacacaaaactagctgggtgcggaggcacatgcctgtagtcccagctactcaggaggctgaggcaggagaatcgcttgaacccaggaggcagaggttgcagtgagccaagatcgggccactgcactccaccctgggcagcagagtgagactctgtccccacctgcccccccaaaaaaactatgtcaatacaaaatattttgtgtctgtttaaccataggagtgtccttactgccttgtataaaattgctgaagctttgtgtatggtcttctacacaatggacacattttatgcaactaaaactgaaaagccgagtcaattatttgggtatatggaaatataactcatatttatgaaacgtttctaagtaacatttctacaatgaagatttataacacttaaagttagaaattatttccaaatatatgtacactaaaaatacctagatatagccgagtgcagtggctcacacctgtaattctagcactttgggaggccgaggagggcagattacttgaggccaggagttcgagaccagcctggccaacatggagaaaccctgtctctactacaaatacaaaaattagctgagcttggtggtgcactcctataatctcagctactcaggaggctgatacacaagaatcacttgaccctgggaggtagaggttgcagtgagctgagatggcgccattgcattccagaagttacagactatcacaattttcctttttatacttatctgtgtttctaaacctttctacaataaacctatactacttttataacttgataaaaaactaagcaaaacatgatttgtccacttgattccaactctgagaacattatcttctattaaatcaccattaaacaatgagcaaagctttgaaattttggaactttgaaagttttaaaagtgttgttataggcttttcttatgttcctggtagttagctaaaatgcttttgtgttacatgttgttatgttacagcaaagcaaattaacttatttgtgcctagcttggatagagcacattatgtgaaatgcactgaagtataaataaacaccaatgcaatacatccgaatactctatcttggagatctattttatcacttacattgtagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgtaagtattaccttgtggaaatctgtgggtgacctaccaaataaggtaagaccacgaatccctccctgtatgtttcccttcttgctttagaatcagagaaccctgctgaacactccctactcatgataatttcccatattacatttgctcacctaaaggaaaatatatttcaaaagcatacaatgtaattagccctcaccttaactattaattgcttgatttatgtcatccacagtagtttgacagaacactagaactagctcatcagattcatcttataggcacttctcaaactttaatgtgcccatgagtttctggggaatcatgttaaaatgcagattctggctccataggtctgcgatgaagtcgccacagctcatcagtgacccatagtttgaacaggaaaggtgtagataacgattgctcttgtattggttggtaagatagattttcctcattctttatgttgaggtgccagggtgtcacctccacaccagtgtcatgagctcttaaggtacaatcagaaaccattgataactacatatcttctgatggtctgctcagtaagaacaaggagaaacttcttaccactctgctctcttttttgacacacatgaaaatgactacattgttgtatctacaaatgataaaattgtccctataaatgggaagatgatgtaaaaggcaaagcctatcatagtgaatggaaattgggtaaagatgttattggaaatggtaagcctttagcttattgcctccaaattgattccctatacccttaatatgaagaaaagtttaagcaactcttagagctatgacatttcagatctttcactatatgttgcaggtgaattttcttggcttcactaattatgaaacagctcttaaaataataggtcagtatttgtcctcattcacaaaagcagctgtcttagtaacctaatttctttttatactggatcttatgtcaacattatattcttgcagcacttttgaacaaaccaaataaagtattttcctgtggaggagcatcttgaaattcctaaaactatttcccatgtgaaaatcttcaaacgatgcttaacaagcgaacacaagtgctatttacattttcatttaggttcaagtgatacctttgtgagctcactgaggtacattttgggcacttttgtgcctatgaaactgttcatgttcctagcctcttatctctacttaattattttaggcagcaacttccatgaaacacctccatagttgtcttttctctctaagggccacttatcacataaaataatttgattcccatatctgcattaattatatttttgaatttttttaaactgtaatctttttagtagtggtaaaagagcacttgaactagtttgcttttattattatgattttttaaatgtagctgagatgaacagtgttataaatggctacttggtctattgtcagcatttcaatagagaacaaaggggttttatttttgtttttgacttgctatgtttttaaatcaacattcaactgtatctattcattatacttaggatggttgcaccattgagtattacctgttttaatcaacaggctggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctggatgtgaaatataatgtgaagttctgtattcatatttgtttctctgtaccccattttaaaaaggcagtttatataaatatattgaatacaagcaaaagtatgttaaaagtaaatggatgtcctttttcctaattcgcacaaatgcatctgcatgaaccagcaatgctgcagccaaaataagcattctgatgaagttgctgaggtttcttaggagatgggattgtcagtgacaaaactgagacgttctagacaagttggttaccattaaagtgaatgtacccagcctctgaaaacaaacaaatgagaggagaaatgagacaaattttgttttaaatagctttaaagtagtagataattatagtagtagggattaagagcatgggctcagtcatgtggggtgggttcaaactctttttacctatgagagagttaagaaattgaacggcagtctcaaatttcggggcatctgtttcctcatctataaaatggagataatactagcaccagcctcccatagttgtatgaggattaaatatacttagaaaatgctcaggatgaggactaaatatacttgcaaagcgcacttagcactcaaactgttagctattctcaccatatatagagtgtatatatcagaatacaatacatcttttaaaattctcatggtaggcctgttaccttttggcagacaaagaatttacagccgagaaagattaaagtggaaaatgtaaataggtaagacaagaggaagtcatagcactgttaatacgctaagcacaggttgggaggttctgttcactccccacaggtgggccacagaccctgcgccaagggaggggtacatggtactgtgagccatgggggtccacaggatgaaaacttacccatcgttgttgtgaaggggaatctttttcagtgccgagatgagggagaaatttcctgagcatcttttagagaagaccctgtgacatagggctcaaagtcctcaacaggcctgaaacgagttgtttctcctgggctgttcctcatgaagcccccgctgtgtgacctgatggcgatgctgccacagaggttgttccataggccagatcatgtggcagtgcgcggtgctctctgccggccttaggtagatttcaaaggactgggagaaaacagcctagacggcatatccttcaggccatccttaaatagtgttgtttgcagcaaaactttgccaacagttgagcaacagggaaatgagctggatattgtacttcctgtttatacctggatgccagctgctttatgtatctgtgaaatacaaaaatgtgcatctaagtcaactaatccaggattggactcttgtcttctcacggaggctcaggatgctggtgtgcatacgtttctgaatactaggcacagagtttggcataggaagttgtggaatttggtgtctacctcaatgtagggacaaggagatcgaaggccttaagttctctgccatagagtgtgggccagggaaacttgatccggaaaaaacatgccaaacagatataagcttgcaagtacccgtaagagcaattttttttaagtacagtagccaaaaatgtttggtcctgaaccatgaaacttcttggtatatctttcaaggtaaaccagaaaccaaaacatgtacttagagagcagagtcaacttgccagatgggattagtgaccataaactgcctaaacgttggggagtaccaaccaggattcatgactctttttggcagttactccatttaactaatccaaaaattgtatcacataattaaggcataaattttaaagcatggggatcagctaagaagccattggtttacgctgctatacttttctgcccaatactgagtccttgagcctggctctcctgggagagttcagggaccagttctgaatgaggatctgtgtaaccaggtgtggtactgatcacatcagccccacagccaactcccatctacagagttaggacagtcagcgacgccctccgttatacatcagtctcagattcccgccccatccttaccaagatcaaagcacatctggctggtacacggtggacactgggaacccgaaacaagcctgcacctcataggatgtgcctgccctgtggtgcctgggcttggcgttgaccagggattggtgtgcatcttagatggcttactgataaggcggtagcctgcattttgtagggagaaacagattgtgcttttaaaggatggtatagatcatgttccagtttgagtcccagggagtcggagagggcacaggggctgggatggagctcctgggagagtggagatggcactgcttagcatgcagccccacagtgtggatgctgtggatgatgttaattttagaattgctgctgacgaccagtactcttaattgcttagtattttactttaaactgattaatatatctttttaaaactttgctttaaactaatatttgtgacatgagtttaatatgctggggtttaatttttgcccttggagcacccacctaaaattatcctctccccctggcttgggcaacattgtcacaaaaggccactgtgtatcatcaagcatcaaaagagatgccttcattccagtcctcagtgaaaaaacaatgtacatgtagcatcaaaagaagaaaggctcctggtttgaattactggtaacaactaaagtctggcccacccattgcttccaacttagggagttcttgagcctgcatggacagggtcatgtggggaaacttgctctgaatccctctctaaggtgctctgttgcgctcagccaggccttggtgccattattgcactgaagcaaggaaggaggatgttgagttccagagccaccttccatagctccgaacagggagagactctcagaaccggccctcctgtggtcttggaggctggctgcctgggccatcctgtgatggggcagcctctccaaggcaagtggaggtgtgccccaaatccaaagtgaggtagaagacccaacacaagtgtaggaattaaaatacataggatttgaggagataaaagtaatcaagatgtaaatagctttctggcgtagctcccccttcagccaggcaataccatacccttggttgtttcaacattagcaaagagctgagcaaataaaagggaaggaaagagggtgggaaaagagcaaaagaaagcagagtggacagaagatggtcaggtgtcctgtcctccccacccccccgccaacccctcatcccttccctcaaagaaggcttggccttctgctccacctctctttgcctcaaacaaaccaagtatattcgaaaggaacagattcaggcagagcagtgttagacttccttgccctcagtttggacatgaagcttccttgttctcagtttggacatgacagttttatttttataagaactatcttgatataaatgagctttcttctgtatttttgctatttgtgaaacagcgacactcgaattcatttcaatggaaatgtagcgatttctcatcttactcaaacagccaaatagttttctaaacaaatttagcaagagaattaatcatggccacggcccagttcccatgacatggtatgggtacttttctatgttctataaatttaaaagtattagcaaaaattaagaaattgctgcttactagtgtttaggaatctgagggtatttataaagatcacacttagtgtgccacctgtaaagacttctgttgctcctcctgtagacatctataagatttacaaaatgaatctgacaatttccaagttgtttaatggaaatctttgcaagattggcatacatttgcatcttctaataactattaactgttagccatcaagaaagaagttttaaaatgaactaagatggatactaagctcagaaaaaaatgatatggctttgtaataaagtgacattattaattcttttacatctttgtagtagcttgagctaattaggacacttgacttacagtaaaaacaattaaccccactttaggttaagcgtgaatgattggagatgggtcacattcacatcaagaattggttagtgtcagatctgattctcagggctccctcccttctccccaagggttagtcaaagaaaatgtcactcacatgatgaggagggccatccctcagtgaaagggaattgtagagttttatttgcaccggtgacttgtgcatcttttgtgagttattgcatttttgctgactgggtgttcaaacaagtttctgtagcaacaacaacacaagatgatataaaccaacaacctaattcacccaggatccttcatctgcaattctcaaagccaaaaggttcagaataccagaagattttctaaataactaattcggcagcaaaacttgacctgatatgaggctactgggtgtctttatatattttgttatagaaatatttaatttcaagatgctgcctcagtttctgctggatatattacaagtccaaaatccacatttttctgaattccaaaatgcatctggcaccaaaggatttcagctgtatggggtggttgtcctccaatatacatcttagtgaatataaaattctggaattttcaggctgggagacaccctggatgtaaggcggcggtggcggggcatggggagaactccctcacttcatggatggtacaatgaggcccagggtcattagcatcaagctaattgtaaactgaagtcactcactcatacctcacaccaaacttcacaacagtgcatgctgagtctgatcacttttaaaacacatttatgatctgggtaaaataatgaagcttgagtaacttatagtggtggcaagaaaagccaaaattcttaaagtccatcaaccaaaatgaattacttctaggataataaaacactttgggttaatggttataaatgattctgtctaaaggaatacagtaattattcacacagtataagatgtattatttacttatttgtccactcagtaaacatttattaaacatccaagtgccagatacgtgcctaggaactgaataggaagtcctgaaaagtatacttcagtcaagattatattttaggtgtgagtggaggtcgggggagttctgtgggttttaactaccaacacatatttattgagttgttgctgtgtctaatggactataaactccgcatccagaaagaacctgcattaggtgaatcactgagcaagaattagaggccaaagttccaggacatgagatgccctgcttagacttgtcactatctccactgaaccttctctggtcaggccaccaccatcttttacatagaatattgcagttgctttgtaagttgcattcctgcttcgaccaccatcctctgcacagcagctagagggattatttgaactttatgtgagccagatcacataattgctttcctcaaaaccctgcaatgattcatcttacccacagtcaaagtccttatggcagccaccaccctccgcattgcgctgcttcgccctggctgctccttcccctcgctgcttctccctctgcctgtgacactcttgcctagaatctgcatgactacttccctcctctccttcaaacctttgctcaaataaagcctatgctgatgatctcttctagaattgcaactcattctgcctctaccactccaagtattccaaatccccttctcccgggtttacctttcaccttgtaacatacagtataatttctgtgttatgttcttggctattgtctgtttccacaaaggtagggatctttgttcactgatgcctcccacccacttaggacgtgcctagtgtgtgctggagtcctggaagtagctgtcaggtgaatgaaaagtgtcataggactggagggtggagccttgtggaggagcgcaagtgatgaggatgcagaaggaggaacagataacttggtttctttgtgtcaacctgtgacatgcaagcttgcactccaagggccaactacaggaggtcttagaggtttaggcaggcatgtggcataatcggatctccacttagttctcctgccccagagcagagagcagactggggtaggataggatcagaggtaggagcccaggtggttgttccagagtgttcatgcttattactgtttttactcctctgagtactgcgatggtcagatagtctagcagctctcaaccaggagtgattttttggacatttggcagtgtctggagacatttttgattgtcgcaactgcagagttgcgactggcatctatggatagaggccagggaagctgctaaaagtattacagtggacaggagagccaccacaacaaagaattacccagccccaaatgttgatagtgttgttgttaagatcccttgcagagaacgtccaaaagaccaactctcaaacctgagaacacccttgtttacgatagaagcaaaataagcacatcctattctccagtcccgcgggcggctccattacttacctcttgactccttgcctctgtcaccgctctccctgtgtgcccaccatttttctctgggcttgcccttcagcctcactgttctgctgagaaggtagaagaacactgcagaggcccgagcctcaggagctggagacagatttgcagccaggagatgtggtgtcactgtgtgcgcaagttccgtgtgtgacatggtgtcagagggctgctggcctggcttgtagtaattcctctgtaaataactctccttagccagccttatgtaaaagctagcctgggtgggtttcctccctgggtgggaggccatgggcttggctatgtgttctcatcttctgatatctcactaggctttgtgtatctttcacagttcccgtggctgtagaattttggatcctgcggagtgggttttgaaatgagcagagattttgtaaaaagaaatctttcctatgaattctgctggagattctcaggcagggagcctttgtgaacaggagcagcaggtcataggcagtccacgcttaggatgacctgcagccccagccctgcgactctcccagctcagggtcagtgctgaatgcccactctgtggtggcctttgtggtacacactctacacacaggatcccatttaatcctcaaactcccctgggggtcccctggcagggaggcttctcaggctgaggtctgggcagtcacacagggcctggtactcaggagggccctgcggttggttgcatgctttgctgtcacttgcttggaattcctaatcgttttttagcaaggggccccacacttctgttttgcactgggctccaaaatcattggtgtttatgaatccctggggagatgcatgtctttcctccttcatttctttcacatttccaaactctgtcttcagcattacccttagaacatcagaagtccctgcaaggcccagagctcctgtgcccaggatccaggctccctaggtggcctcagccaccccttcctgaggggctgcaagggcggggggttttgaagatctctgctgtcttttccacaccctctaccaatactccctcttaagtttgggtgaaattactcttcctctctctcttgttcttattaccttttaacctcttgcactcaaggcattccctggttttgcatccttaataaggttaggtttacaggagacagccacaaccttgtcttgtttcaccttcagtaccatgtcctgggcatacattcacagatacaggaaataactttgtggggaagggtattaactccacacttgaactgcctgaatcctcattttttttccccctattgctagcttgctctgtgacttgaggcaagtaatacaaactttctatgctgttatttcctcatcggttcagcacgtatttactagccccgttgagggcctggcgctgtccatggggttaatgataatgccacctcctaagcactcacgggcactcacgggcacacggcttggttaagttggtgagaatccttactgcccacctgcagggcttgcttgtttatctcaaagtcgacttctcacaggtgctactgtcttttttgtcatttgctcatcatctttgggctttccgatccagtggggtagagtttgccagcatgtgactgaagaaccactgcattagaatcagctggtgacctgctgggcactctgaattttcaacaatctgacatgcaagaacacactaggtggagaatggcttgagcaggcagtggttctcagccctggggagctaaaagtaatgaagtcttgctctggtccagaccaactgggaggaatatctgggaggggcgcaagcatctgtgtcttttaaatgctctctctgtagattctggtgtacattgagggttgggaacaaccatgcctggccctttaccatatcaggccttggaacatgggttttaagaacactattaaatacgagcctctgcctgctttcagttttcccctcttggaccaaataattgggagaaaaggccattttcttccccaaatggtttgttctctttgtgtgctggaacatagccttttcctctgtgagtttgcagtgccagcagatcaaaattataatagcaaatgacaaaagctaagttgtaagataaggcagagtaactaagactctaggaaaggcccatagggcacttcatagttcctggcactgccaccttacagggctcggatgtgaccacacatacagcaagttgttctgtgctgagatgtgaacttaatagaaagatcctgacctagcacaaaacccgcgggttaaaataatagcataatgtattgattcattcctcagtgccagacactgggtcatgtgttgttgtgttgaattctcacaatgctatgaagtgtgagtgctaataatctccactttacagatggaggaactaacgatatgaatgactaaataccttaccatgtcacacagctggcaacggctggtatataaatccagttcatatatttaactgttcaaaataaactagtggtagaaaataagcaatgtcccttagtaatgaggtctgatttgatattcacagactagatctccccatggccaggcttcaggactgtagcagagggaattggaaggttgctgtttctcttctctggtctgagtataaaatcagggccacggactggtgaggatttggtcttggcataagaggatttttttggtttagatgggtgatttgctctctaccgccatctgctggctctctgtaccaagcataggcccaagctccacgtttctcatcacaagtggcacagggtatggtgtccaaatgtggacacctcatctgtgtggtgaaacgccttcagttcacagtgtcaaaagtaacaatgatgtgtatttctccaggaaagagaacttctgtggttttaaataatgaggatggtttctcctgtttctcttaactactgatggatttgtaaccatattccaaatactagcttatatttctctgactcccagagcagaatagaaagcagtataagacagcttcgttgccttctaatgctgcagctgccttggtcagcccagctgggacatcatgattacatttctgttctctgggtttgtgtcagaagtagaaactaagcctggatagacaggagaagggaattaatgtcagaactttgtcagggatctgccattcaccaaggtctcaccagaaggttcccagaagagactgtgtggttctctttaccactcttgcatgcagaagaacaattaggttaaaaaaggatggcaatgggatgttattaggaaacatgaatacagcttttgacacactgatgtcttcctttttaaaatggttatctaaggaatgagagtgacctggtattgtatctattgcctggtggacagacgccatgagattgacttgtctgatgtgacaaaagacaattgatgtgttgaaagaactgagtacttagggagagacgcagttgctctctgagagaaaatgttcacagctcattaagttgatattgcaagcaatgaaaatgtagcaactccttctcttgttctcttcccttccacccatgtgtagccagaaataatccttgctaagctccgcctttacgttggttagttcagtggaaccctttttcaaatgaaatcggagatggtgaggtgtcaagggaaatgcagcagtgggatcctcaaactcccgcctcttgctgtcctatttcctggccctctccttgccaggaacctggcactcttctgaggaatgcaagagctccctggatatggtctgaaaaacactgagtgccatgtgacttgactggttcattagtctgggctgagttggaaggttttggtctttgttcctgagcctcttaaaattttttaaaagagaggatatatagatatatatttaatgtcgatatttaattccaggttgtgggttattataatcttttttccttgctgaatttattcccccaaataaggttaaaaatagcaggacaataaatacagtaaaaaagtagattatttagtttttgctgatgttggaaaatcattaactctttgcttcctgataatgctgaagagtacagcattaaatcctttctgtaataaagcataaatagatacttgaccaaatacagctccaggcccttgggacaaattcaagtcatttggccttgagaggccagacatgctgttggaggccttgggagaactggtgtgttcatgcttacagtgaagccatggattccagacctgcctggaaaagggccgtgtctttaaaacaatcaatggcattataaaaggactatgatctgaatattcaataacagttaaaatatataacgtatcactaagatgtaatgtatatgtctatatctgtatacaatgtatgtgtatataggtacacatatacatttgcatcactttagtttttgatgcatggatatctgcttacatatgtctggcccctttttcaaatgtaatcttcattacggtaggggcctatcttgttcactgttaagctccactgtcaggcacagagtagtgctgaataaaaatttctgaaataaaggaatgaatatatcccatctttgaatgttcttactgagtaacaagggtggtatcttttatttcttggcatctccaaggactcaaatatttgattttgatgttttatttcatttgctcagtaatctttattgagcatctaccacgtgacagtcactgtgccaggtattgaggatatagcagtaaataaaactgataaaactctcttcacagacctttctattctactgagaggaagcagacaataaatacagtaaaagtagattatttgttttttgctgatgttgaaatatcactgactcttcttccttcctgatgatgctgaagagcaaagcattaaaccctttgtgtaataaaagtagatgatgcaaagcctgctagggagacaactaattcagcccctcctcccaagcccctgcaggagctgagaaaaacaccagggagaaaacgggaatatgttgactcctgagtggtaatgaaaccccgaaaagggtaggcaaagagatcaggacaaggagggggggctgtggcaacaggatcatgggcgcaaggccgtgtggttctctgcagctgagctgcatgccctgtcagcttgcaatgacatcctgactgctttcaccatacatctgtccttcccatccttgaaagcccatcctgatgtttgcagtggaggattttgattaattgaccctgaactactgttgccagggtgtctctactcctcctggcgggaataatacatcggcctgtgtgctttttcccaccatttcaagacctgtagcaatgaattcagaggaaggagtaaagacagttatctcatgtatttgtttaaagccttatgccttgaaaaactactttctcttaataaatgcatttatctcattggatcctctcgggaccacagtgaagtgattaagatcaagattatagttaggatgtccgcgtaccccaaattaccccttctgttgtcccagcatcccagctggtttagtatttgtcttggcttttttttttttttttttcttttgagacaatcttgctctgtcgcccaggctggagtacaatggcacaatctcagctcactgcaagtccctccgcctcccaggctcatgccattctcgtgcctcagccacccgggtagctgggaatacaggtgcgtgctaccatgtccagctaatttttctatttttagtagagacgggatttcaccatgttggccaagctggtctcaagctcctggcctcaagcgatctgcctgcctcagcctcccaaagtgttgggattacaggcatgagccaccgtgccttgccattttttttttaatagactttattttttaggacagtttaggttcagaacaaaattgagaatgtagagagacttaccatataccccttcccacccacaacacacatacatagcttccctcactatcaatgtgccccaccagagtggtacatttgttccagtgggtgaagctaccttgacgtgtcattatcacccagatgccgtagttcatgttagagttcactcttggtggcgtatattctgtgggttttgacaaatgtgtaatgacatgtctccaccattatagtatcctacaggatagtttcactgccctaaaaatcctccatactctgcctgttcatcactctgcctatttatctctctgccccagatttttaattttgcagtaaacagtttttagaatgttataattgaaaatactttgatagaactatttagtaggtctttcaacataagaaagctgcttccttagtcaaatacttcaaagtattatgtaaatttagttttagagcctcttaaaggcgttctaattggaatgacagattacttggtcaccataattacagtctatatcttaaggggagaaaaattggtccccagcaaggaaagaatactcctatgtctagccagctggacctagagcaggagtagaggccaagtcctcgaacgtctgatactttctatcccagagacacagtgcctgctggggaggcaaattggagcccatcacatcctggccttgttttaaagtatttaggaaattgatattgcttctgtatttctaattcggattcaaaaactcactgcctaaacaaataacaaacccagtaaggaacagaacagactgcaaaaaatccaagatactgagactcaggcaagtgaggacctgcctagggaggatgaaatagtactactgagagggacgtgtggactttaaaggagtactatgcttttggagaagaggcttgtggagaagattccataaattaagtcggtgaagaatagtattttcactgataaatgtttgatggtattttgagattgaaattggagtttcatttgcatatttctgagacatggtgcatctgtttattccgtaggatatatctagattctgatcaaatatgtattaaacttgtttaatatgatcatcagctgttctgtagtgtcacccacgtataattttaacacaatgttattcctaaaggttgaactgattcttctctgatagcaaatctgaaggaaattattctgaaggttaggttttcatgaagaccaatttatcatcttatatttacttgatgatatagtatttaaaatacattctactgtttaagaccagcctgggcaccacatagcaagaccttgtctctagaaagaaaaaaaactagtctaggcatggtgttgcacacctgtagtcccagttacttgggagggtgaagcaggaggattactttgagccccggaagtcgaggcttcagtgagctacagtgctaccacactccagcctgggcaacagagtgagaccttgtctctaaaaaataaaaacaaacaatcctgctgtagaaacacatagttatcctaagtcaaggaaaagcagccactcttttgcaaactagattacaaggggtggaggaaacatccagcgcttgtaagaaaataacacagaatgggctgggcgtggtggctcatgcctgtaaacccagcactttgggagtccgaggcgggcggatcacgaggtcaggagatcgagaccatcctggctaacacggtgaaaccccgtctccactaaaaatacaaaaattagccgggtgtggtggtgggcatctgtagtcccagctacttgggaggctgaggcaggagaatggcgtgaacccgggaggcggaggctgcagtgagctgagatcgggccactgcactctatagtctgggtgacagagcaagactccatctcaaaaaaaaaaaaaaaaaaagcacaaagaatggtggcagagttgattctctgcctccaagagtctttaagatgtgtcacatttgatggtatcctggttaaagggcatttactttagggttttgtgtgtgtgtgtgtgtgtgtgtgtgtgtgtgtgtgtgtgaatagtgtgaagatttgcttttgttttacttatttttgtcaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggtgaggccctaccgccgtcacctctctgacttctttgagatggatttatttgcccaaatttgcttattaatagaaggataaagtgcagaacagaaccacacagtttccaaatgaaacgttaagacatttagctcatcaagtgggtttttggcattttgctcctgctgttgtctttcttggctgcatcttaaatcatggaaatgttttttagaagtgaaaaatgcttcaatactggtgatgctggcttccagatctttctaattggagatttatgagctaagcacactcatctatgatgaaaccatattgtcccctcgtgcccttggtcttctgcagggggctgcatggagattttacaattttgttaaaggctctctcattcatcatcattagaacttaaattctgattctcaaaattgtctttagcacatgaataagctattatttctttttaaagtctcagatgaaattttgaacagcatcatcagatgaaagaatcatggggcctgagaaagtagtttactcggagcctccagctttcttgctgtggatcatttttattcttttgagagcccaactgggtaaaatgagcacaatgacttatgattccagtatttttgtacctattaaaggaatgaacatatgacttaaaggtttgggatgaagaatgttaccccaatttcagtattttattacttagtgctgagctttagatatgctcaatgacaaacaggccagaaagagggagagtgtgagaggaacagactgatcaatcgattgaatggctactgcctctgggttttgatagctaatatagaacaatgcaaactggactaaagctcactagttcccacctcccttattttgtgtgtttatgagtcgcatcaaaatacaattagtgtagtcattaattctgttttttccatctctaccaagcacgaaaacctcattgatctaaaaatcagtgagaaaaactaaaacaactgttgttctctccttgtgtgacataaatggttatttggtttatacttcactttactcacttctccttttttgtttttgtctttctgttactcttgaattttcccgcttattcagacacgtgtgaaactcatacccatccagaaagaagtgatttcaaggaagtccttcgcttttatgtttcaacaattgttaagtctcagaattgcaaacatccttgaggagccctgactgccagaatcttattccctttaaccattaatttgactagaatctttaatacatttttacactaagtattaaaatttaggaaggctaaaagtcataatttcttgagaaagatgagcatagtgacttcagagggatagtaccatttactgaggagtgatggtttctttactagtaaagcaagggttacattgcttaaaatagtacaaggttgaaacagcatgagatcatgcatgatggatgaggtattgagaacatactcagcttgaggctgcacagtacaggctgcctaagggaccggtaagctatttactgtgcagctcagcatggaagggatgtgccccatcccttctgatggcagaatgctttgagagaaaccgtgctgcatgtgacttattcttgtctgtctgttgcagagctctaggttctcagtctcccagacactagtttgtgttatcagaagactatattttaaaaagtactaattgatggaagtcagataccacaattgcacccaacatgtaaagccttatttctatcttcagatgtttcattcaggctcactcagtttggggtgcctggatttaggtgttgtggggatgggaatgtttgctgaaagctttgtttgagctgcaattgcccctcgtttgccacttctccagcagtgactgtgcttactggccaggagtcctgtgaggtgtccacccccacaaaagtggacccatcacttgggcgcccagggaagcttgtgaggagcaacagagggggatatcatttgctcttcttcatcttggacacattttcttcctaggaaggccaacaaatgtaacatatatttcaatctgtgtgtgctgaaataactattactggaagcacttttatatatttacatacatatataattatattgattatgtatactgatatgtagatatatagatatatatttatattgatctatatattgagagatatatatttgtgttgatatatatttatattgagaaagagatatattgatacataatttttttttttttttttgagacagggccttgctctgtttcccaggctggagtgtagtagtatgaacatagctaactgcaaccttgaactcctaggctcaagctatcctcctacctcagcctcccaagtagctgggattacaggcatgccccaccacacccagctatttttaaaatcttttttagagatggagtctcaccatgttgctcaggctggtcttgaactcctgggctcaagcaatcttcctgccttggcctcccaaagtgctgggattataggcatgagccactgtgtctggcgcatactttttaaaaagctaataataatggcatcttatcctgtaagtactttttaacatgtatgtgtgatgaacaacccttggtatacataaaggaccacttaatttccaaagtgaaagtaatattttgtatgaagtagtatttttttttttttggagacagggccttgcactgacacccaggctggagtgcggtggcaggatcagccttgaactcctgggcttaagtgatcctcctgcctgtgccccccaagtagctggggctacaggcacacactaccacatccagctaatttttgtattttttgtagagtctgtgtctcattatattgcccaggctattctcgaactcctgggctcaagtgttcctcctgccatggcctcccaaagtgctgggatgacaggcgttgagccatcatgcccagccttaaattttttttttgttctgtgaatctcaaaatctttggaaatgttacctcatttgataattcttgctggtttccttcaaatcatgaaaatgacccaaagatgcactaaaacacctttccacactcgctgacaggccatgataaagggctctggtgtgaagttcctatgtcttttcttgttactgttggtgtggtgagcagcccttcttgccttgggctggccgatgaccatgggaagttggttttgttttgttttgacttcgttcttgtgcctaggctgtggagcctggctgatcatgccttgatcgcccgctgtaacatggaagaggcggttcgcagtgtagctttcagccccgacggatctcagctggccctgggcatgaaggacggctctttcattgttctccgagtcaggcacgtactgatgttgaaaatggtatttagaaatgctctcgtgttaaatgttacaattttcctggtcataatacatgctaggaccttaggaaaaatccatttagccattcaaataggaatactatagatctacgatcccctatctgtaattctgaagtcctaacactctgaaaatacaaaattatttgataatttggcagcacagtctaacccaacagactgatgtgaggctgtttataatctagtaatctcttagtagaaataatcatgtgtcatgtgacttgctgcaaaattattgtgtttaatacagattgctgccccagcccccactggggatgttacatgatacattgtgtatgaacctttctaaaatctaatgaataatgaattcccaagcacatctaattccaagggttttggataaaagattgtgggctttgtagtaagccaagaaaagaggaagaaagaataaagcagcacccaacagcaccagatgtttagaggtgagctttagtaaaagatttcttctacccataattgatactaaaatggaatatttcctatttactgacatcctatatactttttactgaaaaaaattatgacccactcttgtaattcctctgaatgcatttgtcgttctctcgactcacatgttttgtaattatagaaaataaatgcagctataaagtaaatatttcccgctttgcacagagaattctccatagctttgattggagaatggtcttagcacagtttattacactacattctcactaccaaccacacataactcattactgaactagtgggcaacattttctttctctgcttagtgacgtgtgaaaagatggctgagtaccagatttctttttcgatggacttctcaagcttccacactacacacacacacacacacacacacacataaatttccagacacctattttatgacattctagtacaccataatgctattaataaatgatagcaggtatgagcgactgttatgtagaacgattatttgctattctttatgtattcagtttatttggagttgatgaagccatctttactggctcaggggacctgctagttgtcataatcctgtctcacaattgtagggaaaaaacaaccccagtgagctttccagtgtgagcagaaattcttaaaagaatctggtcagaaacaaaacaaaatattccagtgactcactgtattcatgacagtgaaatgttgaatgattacatcacaatttaacatttaaaaaggtaattttcttcagctgcttttttgacttgctctttttgcgacaataggtatcaagcttaacagtcactcgtttcttaaagtataaaaaagatgatttatttatgttaatcttgatacagtctccctttctccatggcgtatttttaaaacaatttgacaaaccccaacttttgaaacaaaaattttagggaaaaataatatatagttaaacatgaaagcaaatgtgcatttctttttaaaattttaaaaatcgatacataatagatacacatattttcagggtacatgtaattgaatacattcatataattcgtgaagatcaaatcagtgtaattgggctatccatcaccttaaatattttttctttatgctagagacatttgaattattttctcccatttggaaatatctgatagattattataacctatagttactccactgatctatcaaacgctggatcttatttcttctatcacactgcagtttgtgcccattaatctacttctcttcatcacaaatatgcacttaattaaattttttgtttttactttggaagcccaaaatatcatttaaacagtttgttattctcctaaaatgccataaattttaagacggagtcttgctctgtcgcccaagctggagtgcagtggtgccatcttgactcactgcaaactctacctcccaggttcacgccattctcctgcctcagcctcccgattagctgggactacaggcgcctgccaccacggccggctaattttttgtatttttcatagagatagggtttcaccttgttatccaggatggtctcaatctcctgacctcgtgatccgtctgcctcggcctcccaaagtgctgggattacaggcgtaagccaccgcgcccggccaatgccataaattttaaataataacattttatatatttactcaaaagttaatcctttaattcctgcaggtttggttctctttcaacacacttctttttctgacacatatattttaaaacttggattttctatttgtagaattgctgcttatcgttttgctttttattcttacagagatatgacagaagtagttcacatcaaagatcgaaaagaagtcattcatgaaatgaaattttctccagatggttcttaccttgcagtgggatccaatgatggcccagtagatgtctatgctgttgcccagaggtataagaaaattggagaatgcagcaagtcccttagtttcatcacgcatattgactggtccttggatagtaaatacttacaaactaatgacggtgcaggagaacgattgttctacagaatgccatgtaagtcatgtggaggccttggatgtttctggaaagcaaaattttgaaccaggtgaaggaaatacaggacaagtgtcatggctcttttagaatttgtacagcaggttttctggtttttgccggaaagcacccccacctcagggcaaggaatgttttctgtcgcaagatcctaaataacagacattcaaaggaaaggtatgagttggaacatgttaaactaaaagttgctgcacaacaagggagatcgtgaatgaaatgtaaagacaaggcatagactaggcataaattcttgccattgttataatggacaaaagatatatatctagaatatataaagaatgcctaaggataagagcaaggaaaaaaaaacattagaaaaatgggcaaatctcacatgaccaataaaagactaggaatcagggaaatgatcattaaaacaacagtaaagtaccattttacactatttagactggcaaaagtctgatggcgagaagaggggaaatggaaaccacatatactgctggtgagaacatgcactaaggcatgtgcgcacaaggatgtttgtgacacaatgcctaaatgtttatcagcatgaggagagttgagttaaatgtggtgtagtcatataatggaatactttaaagaacttgaataaattaaactagagctacttgcatcagtagggatacatctcaaaaatatgctgagcaaacaaaagaaagttgtggaatgatatatacagtgtatggtcatttatataaacttttagcacatgaaaaaattctgtattatttatgaccatatacacatgtagtaaatgttttaacaatgcatgggaatgatacctcattcaggatgttggttaccgctgagaagcagagatgatcttggaaagaataacccaatgaggccaggcatggtggctcatgcctgtaatcctagcacttttggagactgaggcgggtggatcacttgaggtcaggagttcgaaatcaacctggccaacatggtgaagtcccatctctgctaaagatacaaaaaaaaatcagccaggcgcggtggcgggcacctgtatttccagctacttgggaggctaaggcggcagaattgcttgaacccaggaggtggaggttgcagcgagctgagatcgcaccactgcactccagcctgggtgacagagtgagactccatctcaaaataaataaataataaataaatttagaaaaaaagcccaatggattttaactctgaaacattttctttaaaattctgtgataaagacataatgttaggatttgttgaaactgtggtgcaacacttgtacactatagtagtctgtataattttctgtatgctcgaagtatttcatagttttttaaagtagagaaaatctgaaacaattgtagaaccaactttcaggtatttggatgttcatgacctgtttagttcattatccaagtcttttgctttatctgttatttcttctttattcctgatctttgcccatttcattgttcattaatgtgtacctaaaaagttgactaaatggtgataatgcaaaatagtcataatgcttctgtcagtgccttgcacacacaattctgcagcagggttagaaatgaatgaaaatgaactggaggtatcatccgtgggtttcagcttgttgggcaataatactcccatcgtaacacagatatccagggatagtcggctacattatcattaggaaaactggttcctgccagaatagaaaagaatagtctattgaaattttagaaaaaatggccctgggagtattagaaactctgagatcagcttagaactccaacacaacatttcaagatttaagtcttcaaagatttgaggatcatagtccttatttacttggattgttttagtcccagatctttgttcttcataattggaatctcttactggttatttggtgaaatgtgcccattgggattttttaaatgctatttttgtgaccccaccataacttttataagagattcatctgacttacataatactcatttattaacatttagtttgtgtgatgctaaaataaatgtcacaaataagactctgccttatcaaattcttcagtgtaccattgcagaaatatgtatttctttgttttctttgcttgacgttacttcatatattttttctatgtgaaaaaatattaaacacatgtttatcatttgcaataataaaataccatcctgttcaggggtggcatcataatttacttcatcactgtcttattattgggtatttgagcttatttctagtatctttgttggtccagctgttggaattccaaatgcccctgtactggtggaattttctctcctgagttacttcctaggactgtattctccaaggcaagaacactaggtgaaagactgtgttccaactacagacgtttttattttgttgtctctttaatgaagttttacgtaatgctgttacagtctagaattttaaggtgccaatttgataatgcaccagtattatataagggcatttattctcaccagttctttattttgaaaatacttattctgagagagaagttaggtaatatgcttaaatgtcttgattttgaattttaaaattgtgtgtggttaaacactttcccaaatgtatgtatgtttgcttctttgtgtgctctctggggaacatccctgacctgctgtggtgggaactgggtagtgggccatccccatttgggaatatacacagcacaacggtcgggattattttcccgcgtgaattacattttatttcatcataatcttgtagattttcagtgcctagtacttataaatttaaataatattcactaattttttttcattaatctactgagcctgaattttaaagacatcacttctgagcatccttaaattatgaaaaatagaagttcaggatgaacttagccaaagtttttaaaacctggcaaagcgttggtgactaaacatgatgatacatgataaaagtcatttcattaataatacaaagcataataccatctgtatcaaggtaattaagtaattgttagtagcttgagacattacatttagtatgataattttcttaagttttttgatacattcatgtgtttattgggtacatgtgaaattctgtgacattcatagaatgtgtagtgatcaagtcaggatatttagggatgcatcacctgaatatttcatcattttctttttaatgtctgagttttgagtgtgggctttctttaagccacgcaaaaaaagaaaaaatcgcaaatgggataaagagattaaaatatgtagttttctgtatttacaaaagttttcttaaagtttcagatctttataaaaaataaattagaataaactttttatttaaatgtaatgttaatattgattattttcagctgggaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtctcaagagaggtaaggccaaaagagatgtttcattgcataaagatttactctaaactgtatacagtacaattaaggctgatcttcctgctgtctattccaatgcactgtttattttatcttgtatattcttatttacttttcaacaattttaaatagaatgtgttgatgtcttctacttttgacatcttaagatatgtggttttgcaaatttaagaaagaatttgctaatagagttattaccatattgtgatttgtaagccttgtttcacatttcgaacaagtcatatttatgtaaatattcatagtttatatatagtccgttaaaatgttgtaactaaaattcttttatgattcagagctattgtgcttatacatggaaaagcaaaggaaatcctttcagacataattaaaatctgatcatggttgtggtgataatagtttatggacctctcgtcatagcagtaattttgcaaactagatttacataactggtgaaatttttgagagaagtttgattcaaagcaaccctctttgccctcatgttttgttgttttgttttgttaaaattgtttgacttcagttatgtggcacactcaagcgttgtagaaggtgatgaattaaccatgtaatgacctcttcttcctttgcaagtttaggcaaagcccatattcaggctcttctgagactcctcaactgtgcctgaaaatccgatcttagaaaagtaatcaacagggacatgctactgcctgaaaactctttcacttgaacaatttttagactaagcaaggaaagggattgaaaaatgcaatcagaaagtcattttcagctaactggcagttttgaagcagtgacagttatggtacaaatggaacataaaatgcataacaagacaccatcactgaaacatcacaaaatgaccatccgtttaaaatgtgcaaggcacagaattatctcaacatgcccaattcatactcttctttttccccacaagagccctttgagtaatagggcatatcttgttagattgagtagtatacttgcagggggtaagttaggcctccaagaaagtacctgggaattcagaattgagaagaaacaacattggggtcagtggcaacactactggtctctagtgtcagaacttgggaataaacataactcgatgataattgatatcctatacatcccaagtcttttaaggtgtgcttgggtctggaaaatagcaatggaaatgtggatctattagaaaagaaagcatgtgttagtctattcttacattgctgtaaagaagtacctgagacttggtaatttataaagaatagaggtttaattggctcacggttttgtaggctacacaggaagtatgatgctagcatttgcttggcgtctgggcgaggggtgctcaggaaacttacaatcatggcagaaggtgagggggagaaggtacgtcacaaagccagagcaggagcaagacagagctagagcagggttcctacacttgtgagcaagcagatctcatgaaaatttgttcacttttaggacagcaccaagaggatgatgctaacctattcatgagaaattcacccccataatccagttaccttctaccatgccccccccccgccctctaattctggagattacaattcaacatgaggtttgagcagggacacatgtccaaactatattacagagggtgagtagtgctgtcaaaatgagtcaccgttacataaaaaacagctctttggataatggcacacagagggcatctgcatgaatgaggagagatggacagccagatgacagtatggtgagaagtagcaaaacccacctcagcaacccacagacatatccatgtcctcatagcaaatggacttgtgttctacttttcatgacacatggcttataaatcttgtaatttgcctctgagacattcaggcttttgtgtcctttttgtgccaaaactactggtggggaagtgaataaaagagtgggaattgttgatgggaatactagcagttggtggaatgtgtctgtctgtaatttaggtgacaaggtacaagtattccctgtacattttgaacctgtaaacagccagatatgggcaggtgctgatgaccatgagcagttgtgggaaatgagcaaacattattgttttccattgtgatttttaaaaactcacaaccaagttaatttgacatgtttgcaattatatgtgtataacaatcagttgcacagtaattagacgtaagtgttctgcagttaatgaaaatgactgctactgtactatgtttacgtagccaaaccaatttgtttttctcattttgacagttttcacatcttaaaataattaggatcaatactgacagctttccctgataccacttagactatatcctgtttgaccatcgccacacagacactgaaacgaggtaaaatccaaggccttgctcaatgacaattttccatgtcctaatagccttggtacgcacccctactccaatgggagactcagaggctctccatgttccacctggtgcacccgttccattcctcctttgcattacacctcagcaacccacaaaagtatccatgtcctgatagcaaatggacttgtgttgtacattttatgacacatggcctatggacagcttgaacagccacctcccatgatgagtgtcctgaatgttaagacttgagttgcagaaatcttggatcttagatcttggaggggctggtgctggccttccatatgtcatggataagcttgatgcagtgcagaagcaggaaggccagtgtggctagaacttagtgcatgaggggaagagttgcgtaccgtgacattggagagggtgacagggctgtgtcgtaaagggccccctggccactactagaaatcagagtcgtcttctaagtgcaatgaaaaactatggatggttttacatggagtgatgtgaccaatccaagcttttaagactgttttgatattttgtggaatggttaggaaaagggaggtttcaagtagagaagttattgcaggagtccaggtaagagatggtgtggcttggacaaagatactaggaagagatacagaaaggttggtcgggcttaggaaacagtttcaaggcagagctgagggtcttacagatggactggatatgagaatagaggaaaagaaagtaatcaaggatgacttctaagtttgggacttgagcagtgggttgaatagtggcagcatttacagagctgggaaaatgagaaaaaagatatttgtctctgggagtgcacataaggggaagaggaatgtctcggtctgttttccttgttgtaagttaggggcccgtactgggcatccgggtggacgtggcacagagctgtcagtgctccagggagatgtcagggctggagatgtgcacttggcagtcacgttgacagcactttaaagccatgggggaggaggttgatagagaagacatgagggctgaggcctgagccctcctgtggtgcagaggacaaagggaggtctggtggagtcattcagtgtcccagggaaagccttatgagagacaggtgtggccttcatttattcaagaagtgttcgttaaatgctgtcctacgggatggagataggccagtgatgaaaacaagcacaaatccctgccctcgtggagcttttgttctactgaaggtccacagttaatatacaagaaaatataaacatctgattgtgagaagtgctgtgaagaaaaataaagcaaacagtgggagcagagaatgctggaattgggcagtgcagtgttctaaatgagttggtcaaagaggggcttgctgttgtggtttcatttgacttagaacctgaaggagaatgaaggatccagctgttcagatatctagggagagagcacttcagacagaggaaacagcaaaggcctagaagcagagaaaatgcctagcatgtttagggaatagcaaagagaccaatgtacccagagcagagtgagtgagcggggagagagggcagaaagaaaagatgagagagataaggcctaagtattaatgacattaatgcttttgcaggttctagttccagcttacaaaggctatattaattatctattgctgcataacaaattattctccaaacttaaaagtgtaaatgcacaaacatttattatatcatggtttctgggagtcaaggagtcccaagaagcttagctgggtgattctagttcagggtctctcatgaggttgcagtcatgtgaaggctagactgaggccagaggattcgcttcttccaagatggctcactcatgtggctcttggcaggaggcctcagttcctgctgtgtgagcctctccatagattgctccagtgtgcttatgacgtggcatatagagatccaagaaagacagcaaggcagaatctgcagtaccttttataacctcctcttagatgtcagcttcacttttgccatattctgttcattttgtatcagagaatttgtggacatatttttaaacctctgcaaagagataggctaattgatctgtgaggaaggtataaaggtcaaggaagcaaagaagaggccaacactttaagatctaaagagagttgggaagagcataccctgctccccaattactcaatcatgagccagcatttccagctgaccttagttggagccagtttgactttattacgaaactgatttaggtaactctttgaagtaggcaagtttgcttttgagacccaatgcttcctttcccttctgcagcagaattcccctaatttttctcagagcccctgatataatgaggcttatctggtcagagcatgctctcaaaaaatgtatgagcatgacatgtagcagtaattttcaccttcttacaaatcattgcctctccagtggacatttgaaatttaaacatgtgatagttgaacagatggcctcccccaaccctaataaaagggatttcatttagagaaactgtgagaaatagaaatgtttttgaagagaggttggggtatttgacctcctgaaatctaccatggactttggggttctaggcctccatgtaagatggaccctgcttattactcgagtgccttgatgccgctgtgtactgagcatatgctgatatgctgaaggctttactactgtagttcaaccacaaatatcacttcaagtagctttttctattgcactcactacctggggttagtgttcactgagtaaagcaaccagtttaaggaggaaaaaatgattctccaaactctatgtctacgtgactccaaacaataattttatttccatagaattattttctgtttccctgttaaacaggattgcctgtcttatctttcatttaaataagaatgtgtaagatgttcattctctgtcatttattttcagaatcagtgaagcagtaggcattatttggaacaggttcagatgtgtctttagccacagggcttaaattttacgacctatttttagcttactgcatattggaataattgagatatattttgaagcatttggttatttgttacaatatgtaagacggaacatcgttttcagatatatttaaagattttactcttcaacatgaacagaaggggggttgttttaaactaatgaactcttcttttttcataactaatcctctcaaaaaatattctttcaggagccaaatttagaaagtatgtgggccattctgcacatgtcacaaatgtccgctggtcccatgactttcagtgggtgttgagcacaggaggggctgatcactcagttttccagtggaggtttattccagaaggtgtcagcaacggcatgctggaaactgcaccccaaggtaaacccagcaataatttcttaacatcattttatttttcaataggcatttcaaagaatggtctaacatgtattctataggtaaaggatttaagcaattttggaaaattgattcctgtaatcttaaaattttaagataagaagaaactttaaagattaacatgggtcagttggataattttcttcaaaggaagttgctataccaaatgcaagttgagcaggacgtcagcaacgtgacatctgcaatgtcagaataggaagctcctgacactccctccactcatggacaccaaatacacattgattcgcaggtccattctctctgagagaaagtcatacaagttgagaaactcctacccaccaggcaactgagaaaacatccacattgggtaggtaggaaaagctgaggcacactctggcaggaaccctaccctgcgcactgcttcctgaaatcaggacaggaatccccaccacccaacctctccctgtggagagaatggtttggacctcacacatagtgccctaactctaggttacccgtggactggctcttaattcaccaactctgggagtagagggagttagacatttgggagtctctagaccatgggaaagaagcctcggtttgatacaagtgctcaagccttccagggacttcatcccctggagcagttctgagaaggagcttaaaaaatgcagcccagtttctacctagaaggggtttatgacacatttccggaggctacttggcggcctggcttctaaccaatatgcaacagggatttagaggggcagacacacattaacccagctggcagcctaagaaacagacctctgagcctcctcccatgactcatcccatcagtaactccagatctaataatatactctggaaggagtttgtccacacattgagctccccaacttttatagcttccactcaaggaaatgcatcctaaacctcccacttcggggagcagagggggcaaagtatatgaatgtctgtctagaccatagagaaaggtggcagttttatatggacttgtaggcacttgcagcggcttcttctcttaggagtggtgacgagaaggtgctataagaatgcagctcctcatttctccccagatggggtttatgccatgtgttgaatgcccaacttttacagctacctcccagaggactccatcctaaacctctttgctctgggagcagaagggactaggaatattctagtcttcctatatcacagaacagagatgtggtcttaaatgggtttacaaacacttacaggagtgacatccccttggagcagtgcagaaaaaggttgggaatgtgcagctcccattttttttctccagaaggggcttacagcatacacttccaatgctacttgatggcctgccatcaaatgatttccatcaaggagctaacagggcaaacatataatagccttccagcagccagagctcagcacttcatgagcctttgctctggctcgccccagtgataaatctaagcctacccatacttactggaaaaagtttggtcatacaccaagtgccacaccttctatagctcccacctgtctccttaatgaactagctctggaaattgatggggcttcgcattcctgagtggacttaaaccacagaaaatgaagaggtagaggtacaatgggcccacttcaggagttatctccccaggatcagagggtacagcctaaatgtgagtacaggcatttgtcacagattctctacctggcttagtgcagaaaaagtgagcggtaaatgactgtgctcagcttcactgtgaagatagaaggaattgaaacacatagtccaccctccaacccttctagctacatcaaaagtgtcttgatgtcttcccccctttacagtcttgcggtaccaacaggacatggcacatcttaagctctaggggccaccaaaacagacaatagtctggacaaacacagatttgagaggcaccttaaaaccattggccagtcagattggtgagatccttctcctatacaaggccagtctgacgagatagggagaggttttttgttttttttttttttttaatctaatgcacagaaaccaacacacagtgtcagtgacaatgaagaaatgaaattccagataaacgagcaagacatctccagaaagcaaccccagttaagtagagatatgtgatttacccaacagggaattcaaaataatagtcataaagaccctcactgaggtcaagagagcaatataagaacaaattgagaactttagagatagaaggtgttttttaaaactactcaatgagttttggtacttttgaaatactttctctgaggattggctgagcacgttgactcatgactgtaatcccagcactttgggaggctaaggcgggtggatcacttgaggttaggagtttgaacaccagcctggccaacatggtgaaacaccctgtctctactaaaaatacaaaaattagccaggcaaggtggagcacatctgtaatcccagctacaggggaggctgaggcaggagaattgcttgaaccgggaggtgaaggttgcagtgagccacgattgtgccaccgcactccagcctgggtgacataacatgactccatctctaaaaaaaaaaaaaaaaaaaaaaaaaaactttctctgaagagtactgccactgaactgaaaaattcaatagagaggttcaacagcagactagattaagcagaagaaaggaacagtgaacttggaaagacagattactgggaaccatccaatctgagaaacaaaaagaaaaagagtaaagatagcttagagacttagggtggtccaacaacttacgtgttaccaacatgccaaaaagagaagagagagaaatgggcagaaaacatgttcaaggaaataatggcagaaaaattcccaagcctaggaaagaaaataaagccaaatctaggaagcgcaaaggacacgagtaagatgaatccaaaaagatgtaccccaagaaacatcttaaatgatcaaaagttaaaggcagagcattataagtagtcagggaaaagagaatcatcacacataaggaaacctctataaaaccatcagcagatttcccaaatgcaagttgaaggtctaaggtttacgtgaagaattaacccttgggggataacaggagaggatacatttcagcttccttaggacaattgtaacaggcagtgggtctgttcagtcaggctgcaggggaacagggtaacctttgaaatgtaagtggccttcagaatggggctcaagcagtggttcacggttggggcctatgtgttccaattcagtggacatgtatgtagtcttttcatttatctctgatgtcagcaggcatgagcaggtgataaaatgaaaaattatttgaataaatgttgacaagagttctgtggtggtttgggccatgacaattaccaacacttgggtgggcatggttaaaaggctaaagaggatctgtattgaagtaaatggttgggtttatttttgccctagcctttcactttttaaaacctgcccattttacaaaacaaagcttaaaacccaggtatctgctatctaatagaaatgtgtaaatgaccaacctaggcaatgtggtgaaaccctgtccctacaaataaaatttaaaaattaactgggcatggtggtacgcatctctgtagtcccagctgccaggaggctgaggtgggaggattgcttgagccccggaggaggaggttgtagtgagctgagattgtgccactgcgttccagcctaggagacagaccctgtctcaaaaaaagtataaatgagtttagtctgcctggtgggtggtgtggggaaggaagttggcctagtctgttaatgttcctgaaaggagtgaagggtgggctgaactaaaccaaaaggtgaaagaaagatgttttaacaatttatattaaatgaaaactatggtatagtttttatttactttgctaggataaaaggaaaaatattttagataatttcagttgctcagagtctcagaatttttgcttgtttcttgtgggttgtatctctgcagaaggtggagctgattcctacagtgaagaatctgattcagatttatctgatgtgcccgaactggactctgatattgagcaagaagctcaaatcaattatgatcgccaggtcggtaagcagggagcaatgaaaatttgtaaccccagaaggggatctcattcctggatttggacatagcactaaaaatgactggcacttagacaaagagaattgaggcaaaaacaagaaaaatagtctactttgtgcctttaagtgcaggttaaaaccgacgtgtttacccaatcataccattaaaatttatttcagcagaaagtaattgcaaagtttgaaaactgaacccctggtatttgggctttttgcctccctagcacctaaaactttaaaatatattttgaagaaaaatgtgcaagtaagccataggtcttttttcactttcttagcagattatgaaagcatgtgtttcctttacaaggatggatacccttgaggcatggtggtttgcatgtgagcttgttagcccggtttttctattaacttactgcaaccattatccatttaatcaaagtaattatctacttaaagtaaaagctcaaataaaatgtgtattaatctctccagtcagaaattacctctagtaggaaagctgatcagctgacttcagtttttttggaagttgacatatcattttagcactaaacagtgttaaagcaatccctcagcggaatctgaacacataccaccttgttacagcaataaccatgggggttctctttttctttcttgtcacttaacaaagatatgtgaagcagattctgtacatgaatgtggaatgaataagacttcaaatttcagatacatgaactgtaagtgtcgccaatagagatttaagatataggcctatggcagctaccatgtgttgaaagaagtaaagtaacttgcccatgtccacgttgcttgtcgtattaggataacaatgcttacctaggcttatctccaaagtgcacattctatgcactacttggtttgcctctatataagcattaaattggaatatttttcagcccataatcatcagtcattgattcagagtttgaaaaattgtgttcgtaccaagacagtttaatggtttgggtcagccccatgacgaaatcatcttgactgtgcattgacacattgtattatgcaatatgactactaaaaaggacttgaaaagagattattgtctgtggccatacaaccctgaacgtagtcaatcttgcctgaaaggaaattattaatgtggaaatattatgcaaacactaaacaatattatactctggtatcaggagacaataaaatttaaacacaatacagaatttaggaaaagaaatctttaattgggaagtgtttgtttaataaaatggtgctagtagaagaatgaaaagggaccaggcacagtggctcattcctgtaataccgatgctttgggaggacaaagtgggagcatcacttgagaccaggagcttgagaccagcctagttaacacagtctctgtatctacaaaaaaaaaaaaaaactgctgggcatttgcctgtagtcccagctactcaggaagctgaggtgggaggattgcctgagcccaggagattgagggctacaagccactgtactccagtctgggcaacagagcaagaccctgtctctaagaaaaataaataaaagaatgaaaaggtagacttaaaattcatgcctacgacttaaacagtttgaatatccttaatgtgaaaatctgaattctccaaaatccaaaacttcgtaagtactggtttgatgctcaaaggaaatgtgcattggagcattttgtgttttggttttggatttggaatgctcaaccagtaagtataatgcaaatattccaagatctgaaaaaaatctgaaatccaaaacatttctgatcccaaacatttcagataaggaatactcaacctgtatattctccctgacatgtcactttccaatgctttcaccgatatttgatttacattcacaatattcctgagttattccttaacagggattttttaactcaattttacagatgagaatttgaagcccacagaggttatgagacccatttaaacaatagaaatatcaagactagaattcattgctctaaagtaaatagttggtgagctgatgaaagcatcatgaattaagttgaataataatctttagattctagaagcttggttaattgcatctgtagtagacaaaacagtagtgagagttcttctgaccttttacaaatgatttttgatcaaatcctaaacaggggccttatattttatgatttttaaaagagtttgattaaataaaaacttgatgaagatgagaaattattactagattggatttgattctccacctgttaaatggacatttcttggtagtaaagtataaatacacagtaaacaacagatgggtttttatatgcgtttaaatggtacaatcagcagcacgttttaggtcccaagttagaccaagattgatctttgctctgtatctcagatctgttaagatgcatgaagctatgaagtgaatgtgattccaaagagggatttcaggagaaaattgtcatgactcatgaggtccacatttttcaactgtcagaatcagtaagagatttctggccttagaagaaataaaacaaactattttatttatattttactgatacttaatttcctttaaaatttactgatatattttctagacattaagaaaacagtaacaaatcaagaaagattattttaaaatcccaattatttaaaaaatagttcatattagttttattcattaggaaaaagtaatattcattctcatgtcttaagttttcaaagacattttattgaagcaattaaagattttacaagaatgtcaagatgctgatatttttggaacctgatgaaaggcatctcacccagatgtttctgttgtactttaaggtttacaaagaagatctacctcagctaaagcaacaaagtaaagagaaaaaccacgcagtgcccttcctcaaacgagaaaaggctcctgaggacagcttgaaactccagttcatacacgggtgggtggcctgtcatgggcgcccgtatgtgttcctctgtctctgcctggctgtcaccaaccttagcaccaggcttaagggatcccctcccctcagtgtcgtcctcctcctggctagctcttctctgcaatgtgcacttgtacctgtggttgctattttaagtgtgactctctatccacttccctcgttgatgttctgtggccatcacagtgtgattgtctctagatttctcagacttcatataattccatgacttaaagggtgctgctgctcattgctgctgcacttctttctcatcaccatcttcacttcctctttctcctttcccctaatcccctgctgtgttttgctggctccaccataggacagtattttcttcaaatattttctgcacatgtgcccaacataattttgaattttgtaaaattatatgcacccttgcatattttaagtagacaactaaaactttttaatgtcggtttaaatggctgagaagatactatctgtattatgaatacatcagtcctttaaatggatgcaaaggaacctaaatgccataaatgtttgattctcactatgatcaacttaaaaaatatgtgagaccagacacagtggctcacacctgtaatcccagccctttgggaggctgaggcaggtggattgcttgagcccaggagttcgagacatggtgaaatctcatctctacaaaaaactagccagatgtggtggcgtgtacctctagtcccagctacccaggagggaagttgaggttggggaatcacctgagttggggaggtctaggctgcagtgagctgtgatcttgccagtgcactccagcctggttaacagtgaggccctgtcccaaaaggggaaaaaaaatacctgaagaagtccttctaaaacaggaagctattttacatcattcatatttctacctaagttcacatttccattctaattttcccataaaattttaccctaacataatctttttatgcttgagagtcctttgtcaccatgtcataccctctgcaagaaaaaaaatttttctgtggtcctaagactctaactcagcccaatacaatatccactagccacacacagtcactgagcacttaaaatacggctattctgaaaaaagatgttctgcatgtgtaaaatgcacaccaattttgaagacttactatgaaaagaggaatgtaagatatctcataagtttttatattgattacatgttgatatagtaatatcttagatgtgttttgggtttaaaatgttactgaaataaatttttttttctaatatggcaacaaatttttaattaggaggatcatgttatttttctgttagtgttgctccattaacagtttatttgaattatagttattagtaaagtcgactaaatcaacatgaatatattactaattgtgacatataattattaagcacagaaaaattttgttggaaattattttaatatgatggattggttttcagttgcaagatctgtgcatttatattacttactgttagaatgtaacaaagtttaatattgagtctattctcagttctcatttttgtatagatgtaagcagtgagaaagtttattctcttaaataattaggtaagaatggaggccattttatagcaatgttattcaattcttcagactcctgtgataggccaaaaaagtcatatttgattttgatatatcacaaaaaataatctttcagctggtaattccattaagtctctgtacaattttgttgaaagcaaagaattggaaatcacttgatttgcaggattccttagccagtcattagagttgttttctttcaacatgcatacttgtattttgaattgttcctttgttttggtgcccctggaagggtctgtgtcccggagtaatacagtgtaataggattccagatggaggagaggaatggctttctgcagtgggcggaaggcatttatgagaggggagatgggaaaggaatacctgtgcctcatcacagatgtgttctcagatgatcgtttttaagaaaaagcgcacacaacagctgaggatctgctaacagattctgttacaatgttcagtgcccatgtgcctttttgagagtcatctcatgccctcagacggccacatatcctcatttaaacattgctgtcctatgtgacacctggggttccacttgtacatgttcacgtcaatatgttagccttgcctctgacacctcctgctccatgcatttgctgtttgttcaaccactatgcatttcttggacctgtgcttcagttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggtatctatctcctgtaaactagggcctagccaaaaagagaatttaatttttgaattcagtttacatattagaaattcaagaaatgcttggtagaaataaacatgagatgggaaggtgaagattgaatgatcattggatccttccaagatcatgggagaatcaagcaaagcattttagcattattgggagacctctgaggagttcttttcctggaatgatgagatctatgaatgggaccagctaaaactaaaatggtgaaagttttgtcaaggagcagctttatatacttcctcgctgtatgcccaggatttagtatatcctaggtactcaataaatatttattgaatgaaccatttaaaaatactataacatctagagtataattatatttgtaagactgaaaaccataagacttttgactaatttgtattttagccttataaaaacaccttgaattttatctgaacttttttttgaaatgccttaaccttagattgagtctgtaattgaaaaagctgctaaaacagggaccctctacaatcatttgggagtgtaaagagaaaaataatcattaacttattaaagactttattaaacacagatgtattaccttgctggcaaaagagtaatattgtcaaaagtatttttagttttatcttttcctcaaatgtatagattatacttttgttcagtttttataatgagtgtttaattgcagataatacttcaactggtattaactaagtggcaaattctaagaaaacattcttggtataatgtcaaaggttaacatgagacaagcccttttcctgagactcgacctgcaggtggtaaagcctttggacagagttcataacctggggttcatgaaatctatgaatgaaaatgagaacatgaggggagtcaaccccttaaaaagttgtatttgggggaaaaaggatccatagcttttaaatttttttttaaaagggttgcagtcctccaaagggtaagggctgaccattggtttatacatgaatttgctggccctccaactgaaaaggtatatttgggggaaaaaggatccacagcttttaaattgttttttaaaagggttacagtcctccaaagggtaagggctgaccgttggtttatacatgaatttgctgtccctccaactgaaaattagagacctactgtgttagctgatgttataaggttttacaagtaattgatcattgctttgctttttcacttgcccttattttttgtctgtcttataaacagatggtgcttgattcacgtgtatttaatagcctctttttttaagtaaaagccagaggtgttttttttttacataaatccccaaggagttactgcactcaatactgtatttgatggaaggtaaaccagtggcaaacagtattccagcagccacctgcaggagactgggcctccacagacctctgtaggagtggcctggattctgctcatttatgcctatggctttatctcccatttttccttttaaagtcatcacacccaacaggtttccccaccccccactacatattacaagtgagaaaaaccactctactattataattttctttgttgttggggattagtgtgatagaagcttgtatccctgcaaagataatccaccttactgaaagatagttatgccatgaaaatgttatttcccagggggagaagcggggccaggccttcttctggtgggtagcgtaactgagaatgggtaaaataactctggatagcgtcatgacaatgtacaagtgacttccctgactgagaagcagaatcttgtgtcgagctgggaaggcaggagagggaatggtagaagtaactgacaaaaacaaggcacagtggacatttgaattagccttaaaggcccaggcatcaggttaggctctgttggaactctacctgattgccaggacaagcctcttagagatacagtgcctcagtttcctcatctcaaaaataactgaattgtagcagatgatttcctagggtccttctattctccaaatgggtttatcttggtttctgagcagtgttggactctaaggaacaaaatcattgttagtataacgtgttagtagttaataacagtcattctgttatttaaggttggaagagatgctgctattcatgtgtgggacacacaaactctaaaatgtttgtcgctgttgaaaggacaacatcagagaggagtgtgtgcacttgatttttcaggtaaggtccagagtgattgacacatggttctacgttgagagagagagagacacagagagagtatgccccgcgcatgcgcgcacgcgtgtgtgtgtatttaaacatgctcccacttagtcgttctgtttgtattgaagtacaagctctttgtatgccagctacccgctcttatactgagaatcatacataggaatacctcaccaaaaaatgtggcctttagattacacaccgcttcccatcttcctcattttctgtctcctaagtcactacccagagctcacactgtgttctgtatttgcttgagcaatttgaaatccagagcagctgttgctgttgacttagtcgcaaatgtctggcagtgactcagaacatcaatttcatctctccaaataagtgggagcacatcacttctgattgaaaatacaaagtactagagagaaggctgcaaattatctgcagagggccagtttacaacattggtattttggaaataacttttatatcgaaaaaatagaactgaagttttcatctccttaatttaaaatttgaacacagtatcataaaaaataactgatgaaagttaagttcctttagagtgagtgttctttaagttggcatttgagaatgagggcctatcacaaaaagtatttctacctagaaatttttaataattgcaactgtagaaattagatcaatagaaaaagaattctaaactttgtacagaatgctgattttataatttttttctaaattttattcaaatgcttaataagtataacgtgtaatattattaaattccatgactccacaagcctgattgttctcccctgtcccttcctctccccgttcaagccctcactctttcatctatgctatggtagtcatgctggtctctaattctatcccctcttcctcagtccatcccaccctcttctggagtctcccaaaagcatagttaccattgccaccacatggattccccttggttggctgactcattgtggagcccttgggacatccatggccttccatgatctggccttaaccttccttagcagcatttttaacccaccagcccattagtgctccttcacatctgtctaactgtggaggctacatgcactcttgcccttcttttggctgtgttctttgctcatgctgttctcatgtgtcttttcaagtcctcccgccctttaaggtcaagctggaagttttctcttccaactttacagggagaaataacctgtccttttttgtgcatcccttagccctttgttgtcattgctcttatggcacccattgctcttgtggcactccatgtggcacacagttacttgtgtcagcgtctcccaggcatttcacacacagtaaactacttggcagtagagcccatctgtctggtccccactgcacatgtcatattgctgtgcaaatagaagctactaaaaaaagtgaatgactaaatgaacaaatgaggttctgcttaatgcactttgtcttgcctttccctattactactagaattttacattataaaccacgtttgggtgaaaactaccttcattgcctgaccaatgcaacatggggcagtttttagtttttctaacaggcatgttctcacatactgtaaattactctacaaatctgagctgctgtatcattattagaagttattcagtgccttcagtgattatcaaattggtaaaaatcaaggttaaacagtttatactctacactggtgacatgtgaggtaggagaaggcataagtgtcaagggagagagaactccgcataccacctgccagctgaataacacagtcagtaattcactcaataaacagtgaatacaaagtccaaactcccggaagtgtgatggacatgcagttttaaaataggtgtgctgtgtgtcactgataaagcagtgaaacctaaaagaagctgtaattttagttcaaatacgattgtatttcaaagatgtggatgaattccttctgctttttgttctccatagttccactcctcagtggccaaactgcctttttcctaaaattaattttgctagcagacaaatatatgtatacttaatataagtaattaatatgctttagaagagtggtgaaatgcccgttaaagtagcaaaaataaataacaacagctaaatgtttacaacattattgggaatccaatatattcattcttttggcagcactgaaaattgactcaattctagcaaacaatctggcaatgtataacaaagctgtgattcaaaatgacaagtatgaagattgtattttatgcacatttcaatgtatcaagataaaagaaaaaattgaactcaaaataccatctatcactgactgcaaatgagaatgtgcatatgtgtattagcatataaataaagtggcaagaaatttagagtaatataaatagaatttaatcatttggttatttcctctatagagttgattaattttctattttttgaaatcgaaataattagctcgtgttattttaaatacctttggaagaagagattagcagatcaaagacattaactatgagatgagttggtagcaataagctggtacccagtaatgtggcctcttcatttcagatagctaacatttcttctgggcttattagttttatagaagaaagaacaagaaattaagtgagcttagaaacctttttcccataaggcagcccttcagatcagtgcctgggtagagaaatcagatactctggaggaggtgaggagcccgattctgtaactgcttctgattcccatcttgggcacataaattcccaaatatgaaatgttttgtgcataagaagggtatttcagtattttaacaatacagtctccattccccagataacaatcactgggaaagagcccatttttcagcaaatgtgttgtttttgcttatggaaattcacctttttgtcttacaggttaagtagtatgtcaatatataaatggtagaaaggaatctgatagttttagaaagtactaatactaaggactattgtggaaaaactttgactgatacgtgattcattaccataaatggttacatacagatgaattgtagtcattgactgggggttggggtgagggtgtggggacctgtggtgactcctgaaagtgtgagctgaggcctgtttggtttaatttctattgatagtctatgttttaataatatagtttgagtcttaaatccttgcaaccactttataggctgagaatggacatcctgaagtttggtggggtggcctgggtaaaagtgaacagtggccgatccaaaggcagaacccaggtccattgtgagagccaccaggcctgggtttgtcagcaggcaggaggcatgccaggagttctcctaggtgtcaggcctcctccagccgcttccctttgccgatgctagtgtgtacacttggcaagagtgtcatacctgggacactcagtgtgcaggctcactttctgctacctgtgccctccagtaagcttgtccatctgcccttcccaccctccactgtaactgtggagtggacatggtagtgcatagaggcccccatgtggaacagccccaagtgaagagagatcccgttctaaaacagcccagaaacacacacttacctgaagtatgaacaagggcaactaatgctaccatcctttggaaactgatagaaaagtgagtagctcaagtagaaatgttgaaagaggagactacgtagacctccttgtttaacggtgtaaacagggcactgacgtgacactcaacagttacgatttagctagtgctccatctgtgtgcctcaggactcctgtcgctgcccatctcttaggagttagctcttttggggggttttatggacacctactgatagcgtgcttgtctcttactagagaataaattgtcctggaaatataaagcaggcaaacaatgtgaaaactagataacaaataagcacagttatgtgtgaggatttagattgttcttgccacttttcgaaagcaaacaaaagacatttttagtcaaaaacatttcttgggcaaaatctgtaactgggctacaaggacaagaaggaatgaatttatattatctcagttgagaacctcttttaactcagtatttattactgtctaggggaaggggaaccatttttgttttgtgcttgccgtgaggaaagtgcttccatatgaatagaaaaccagattagaaatagaaaaggtcaaccacagaagtattttctagcctaaatatcaaccatataatttttttaaaagcttcgtagaataatactgatttccataagggcacatctaagacttgatttcattgtgttcagtagaaaacctacgcattttttatgagtcctgaatagagagaccaactcataattgtctgaataaaactttgtctaattcaccctttactactgacattaaatgccttcatattatttctggactatgtcacagacatccataattaatgcatgctgtgactgcaaagatgggaaaggacattacctaagagactaaaaacatggctaaaaataaaaaacttcaactaactggtcagagagtagatttccaaagctaagaccacggcttacagggaaagtgagaactgggaaagagtaaaaaggtagccaattttatttccaaactgtgtagtatatacacagaaatagcccacacccgcagaactcggggaagtcaccatcccaaaaaagaggtatggctgttgaggcacctctgggtttgcactgctgcttccattgctacccacaatcagaatacctttttttggtttagaaaggtggtataacagtgaggataagctgacagggccttgcagaaattctcctaaaataaaagctcacctcttaccccggcaaaatcagcttatccttaggccttcttcagatgacataaaactttattattttaaatgtatttgtgcttgcattccaagaagaacataactacacagatttcaaaagaaaacatgaaatatagtcaatgaatgcaacaagacattgaatatttgtacagtgtttttgaaatggacaatttctttaaaaatctgtttataattaacacataattgcaaatgtttacagggtagaatgtgacatttcagtacatgtatatattgtgtaaggatcaaatcagagtagctatcacatccatcacctcaaacatttatcatttctttgtggtgataacattcaagatcttcttttctagctattttgaaatatacactacattattagctatagtcaccttaatatgtaatataacaccagaacttactcttcctaactgtagctttgtactcactcttgactcatcatccaaaaaaaaatttttttttttttttgagacaaggtctcactgtgtcacccaggctggagtgcagtggcatgatcatggctcactgcagcctggacctcctgagctcaatcgatcctcccaactcagcctcccaagtatctgggactacagatgcacactaccatgcttagctaatttttttgtatttttgtagagagtgggtttcctcatgttgcccaggctgatcaccaactcctgggctcaagggattcacctgcctcagcctcccaaagtgttgggattacagatgtgggccactgcacctggccaaaatctttatagctatataacgtagtacattctatttcaatttataccatccacaggcatattctgtctttatcttcttcctcatcatcagtgtcaccagtatcatcaacattcattgaaaacttgattagtgtgatacttacaaaggaaatgtgataagattattaaaagtcttaaaaaaaagcttatgatattaaaaaaggagagagaaaacaccaataaaaataaaatcaagtgcagaggcatgccaacatagaaacaaccagaccatatcaagagatgtggaaaaagtaatgttggtaatgaataggaagtcattaccaattccttctcctaaatgctaaagagggaccttgcccaatttaaagcctggtaacatttaagcataaggggatatcattagttgtttttgaaagacgtagtttataataatcacctggtgatgatttagcccttaaggaaagtgttaacgtcttcatctaatactacagcctagtagcttgaaagggtcaggtaactttcaaatccttgcctcatacttcgtagtgatggagggttggagaggatttggtttgttaaaccagactttttctttctctgactctccttcatccagaaaaggaggagactaccatttccagttggttggaggagggtctcttgcataagcaagggccctcaaagcatgggcattggttagcaattgagatggggttgccagattaagccaacaaaattttaggaagctcaattaaatttgagtttcaggtaaataatttttgtcataagtgtattccatgcaaaataaggataaatatgtaatatacatataaatattgcatgggacatacttgtactaagaaattagttactgcttacctgaaatgccagtttaacaaggttttctatattttatctggcaaccctaatttggggtatactgcaggtctgcctttgaaaataccggttgggacctccgagtggactggcagaactggaagaggcaatttatcacagacctgtgttgctttatttaccctcatggctggcccttggtagtcagagaagagccctgatatactgatgcaggatgagcttgatcactcgtctcctagcaaccgcacagctagtggaagggagactgctgacccagagatggttctgtgttgaatctagccttgcaggaaggcagcaaaggaaaggctttttgactatacctcttcttttgtcttgaagggaaaaagcaaattaagtgtttttatttgaaatttaattgtgcattcagtatatttttaaaacaatttttgggaaaataacctaaatgtccaaattatagtaatcatggataattattattctcttagagaaataaattgtcctggaaatgtaaagcagacaagcgatgtgaaaactagacaataagcagttatacatagggatttacagtaatctattcttgccacttttctaaacaattataagtaatatttaatactaaaggaaaatgttcatgatataatagatgaagaaagataagataacctgttcattattattctggtattgttttttctaagcacatttgtgtaaagattggtaggatatatatcaaatgttagcctagaaattgggaagatttaaaaattttctgtatccatattttctaaatttcctataacaagtacactacatttgaaatagggaacataaaatttttaaattgtaaaatcatcttttgaaagaattttttaagttaaatttagtttctataatgttcctaatttggagaattaactgaacccagtttttagagctgaaaatggtctcaggatcacaaagccaagtggtacctcaagttaaatgtcatgagatttgtttgtcacaaaatagacatagtttttgtagcttacctgagagtctccctctagctctgtgtctcagaatgtcaggtcggcagtttacttcggcagcccgttatgcattaggaagctcggctatctctagtcatgcatttcattcagcgaggtccatttagtatatgataccccttatgtattaaaatataattgtacatgtttatagagtatagtgtgatgtttcagtacatgtatacattgtataatcaagtcagggcagctatcacatccatcacctcaaatatttatcagttcttaagatcagttacttattcctctttacagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaatgatgtcctttctgtcttgcgatataaaatcattttgaagttaatagccttgaaccccaatattcactttttaaagtaatattttcctctacaatattaaataggaaaaaagttttgtggggatttaatgaatgaagatttataaattgctagagacctggaggagcagcagatggaggcatgaggactccaactgaccatcttcggagaaaaagggaagcttttctgatgactgctgttgagattgaattcttggcaacaaatgacagctcataaatctgcctgcccaagtggtttttcttctggtctttgtttctagtattcctcactgtcattccactcccttctagtagtactcagattcagcttctcatcagaactctgttccccccagactaaaatacagaatttaagtttaatatttctgataatataccatctgcctttacagataatttcagggaaagcacatttctggatttcaaaagcaacagaaatgcaattttcctgctagaaaaccctctgcagctatgggtggctcaccagttttatgcccgaaacattaatagaaatggaagaaagaaatatttcttaatattaaaatagtatatattttatatacttgttggatagtgttactgcctctatttaacacaaagttgacttaacaccattatgttaataacacaattcatatttggaattgctcccaagccttatgacacattcccaaaacaggatacctgcagaattgcccaggagaacattttggattgacattagccagtgctgtttccaagcaggaatatcaaggattaaagttctttggaagaacagtagattttacagtaaaaagtaaataaaagttacttaaatatctatttgcataatattaacaatgatacatatttacataaatacataagaaatttagacaaataaataaagcttatatgtatggccttagagtgcttaagtagatagaaacttttaaaaacaggaggccgggcatggtggctcacgtctgtaatcccagcactttgtgaggctgaggtgggcggatctcctaaggtcaggagttcgagaccagcctggccaacatggtgaaaccccgtctttactaaaaatataaaaattagccaggcgtggtggcgggcgcctgtaatcctagctactcaggaggcaggaaaatcgcttgaacctgggaggcagaggttgcagtgagccacaatttagccactgcactccagcctgggtgacagagtgagactccgtcccaaaaaaaaaaaaaaaaaaaaaatttaaacaggggcatgatagaagcgacaacgaagtaatccttaacggaatgataccttgcttccagggtcatctaagctcccaagagggcctaattcacagagaagctgattcagtcctacccctcactttacacttctgtgtctcgatcactgccagcctcatttatagagcaaggctgaacaattaacctgcttctggctggctgtgctgttttggcaagggtgattgttctgtaccactcatcgcccaggaagtgagatttctccacagaggaggagcatggttggtagctgtggtggcatcgtcagctgtgctgctggtggctgtgctgacgtgtgccagctgtgcaaccaggcactcagaagttgctcctcccctgattggtgagaatattttaaatgaacctactctttagcagctcacagaaactagagaaattcagaattggaccatagagatcttatttacaagatactcaagattttattttcaagatctctgtgagacgatccgatctgtttaaacaatttccccgcatgcaatctttgctaatttttatgagtgatttcggttacctccattacaaatgaattttttagtcttttttttttttttttccctaaagatcattccaattttagtctagtatacaagtatcccatttaagaaccaaggctgatctcttatagaagtagttacagggtgtaacatcactgtcaatcagggcagaataatgcaatgattaatcaggtacatctgtgctcctttatttgtgcttgtgttactctggtagtgtgactaggggaacaatgaataggagggatcttggacaaaaaagaattatcaacaagaacacttcccaggctaatctgaaagttttgctgctagaaagcttagggacaaaggccgggcgcggtagctcacgcccgtaatcccagcactttgggagaccaaggcgtgcggatcacgaggtcaggagatggagaccatcctggctaacagggtgaaaccccgtctctactaaaaatacaaaaaattagccaggcctggtggcgggcgcctgtagtcccagctacttgggaggctgaggcaggagaacggcgtgaacccgggaggcggagcttgcagtgagccgagatcacggcactgcactccagcctaggcggcagagccagactccgtctcaaaaaaaaaaaaaaaaagaaagcttagggacacactaagcttatgcatatggcaggcgtatcgaacttccaagtaagcacttctgtattagcttcatcgcttgatctattttaggtccctacctttacatgcatttaatgactatgatagagtctcccgcataccatatgggccccttttctttttcactttgttttttaaaataacacttattctttcctctgtttttcaaataatatatgatcattatagaaaaattagcagggaaaagcacttaataaaaggaaaatcatctataattccactacccagatgtagccatggttaacattttagcatatatcttttagtgtgtatttttctagtatttgtattcatttttatttacatgtggagtattgtacatatgctctataactggtttttttcactcactaatacatcatctcactgtgttctaatttgttacctgtcttgttctatattattctatattttcagccaatttaaattttttttggagttagtatatgtatcaaacattcatcagtcttcctgttaaaggctactgccacagaaagggagaacaaaattacacacaggactgggcctctatgcaaacagagttctgaatggacagtatggaaaccaagtcacccagtgtgcagttgcccttggcctctggaagaggctccttccttcgtgcttgctggtgggtttatatggccctatgcggtgaattccttgtgatggggcgtgaggaatcatccagtgttaggacagcagcacagtgtgtaagttcttattctcgccatctaagatctgacaaactctttgtattttgttttgcttacacatacacacatgcacatgtgtgcacaaacacacctacacttgcaggcaacttccctacaagtttaacaagtgtgtataagaaaaatgacaggtatgcagtgtgttctttatttatatattgacattagctaaacatttacatgccatcattagccactttataactagccacaacagaaataaccttggtgtttttatgacatagagtaggacaacaaaagctctcacccaaactcaaagtgctttttccgttttctcactcaacaacaatctgcacagagacttctgtgaccaaacttgtggggatttctccccaccagcaagcaaacaattctgtttgctgagtattctctagttccgttctattctgacactgtctacctggaggtagcctcagatgccacaggttgagggctcagtttctgagaccgttcccctcatcccaccttgggttcgattaatttgctggagttgctcagagaactcggacatacttacttcatttgccaggttattacaaaggttatggttgggaagctatatagggcaaggcacgtaggaaggggcacagagcttccatggcctccctgggtgcacctccctccagggatctccttgtgttcagctctctagaagttctccaaaccctgtgctttggagtttttactggaggcttcattacataggcatgattggtttaccaactggcgatgggtgagcaacttatcttttgatccctctcccttccctgaaggtcaggaatggggctgcaagtcccaatcctctactactgctttggtctttctggtgacccatcctgaagctacctctgggctggcggccatcaagtcaatcatgagcatacaagaagacctccatggagatcctaaggattgtaggagtagtaggtcaggaaatggagggggagaattgaagaccacatatgtattttgtaatatcacaatggcactaagaaatcagatgtaaactaaaaagttctcacaaaaaagatttttgtaaatgtttggcattgtataaatacaaggaaacaatcttttatctctaggaaatataattttctgtacttgttattttcattttggttttctctagtctctctaaagtatatattaatgattttgtatctagggagattttcctccaatcaagaaatcattgggctgggcatgggggctcatgcctataatcccagcactctgggaggctgaggcaggtggatcacttgaggtcaggagttgcagatcagcccggcccccgtctctactaaaaatacaaaaaattacccgggcatgatggtgctgtagtcccagctgcttgggaggctgaggcatgagactcatctgagcccgggaggcagaggttgcagtgagcccagattgcgccactgcactccagcctgagtgacagagtgagatgctgtctcaaaaaaaacctggcacggtggctcacgcctgtaatcccagcactttgggaggttgaggcgggcggatcacctcaggtcaggagtttgagaccagcctgaccaacatggtaaaaccaccatctctactaaaaatataaaaaattagccaggcatggtggcacatgcctgtaatcccacctactcaggaggctgagacaggagaatcacttgaacccgggaggcggaggttgtagtgagccgagatcatgccactgcattccagcctgggcaacaagaacgaaactctgtctcaaaaaaaaaaaaattttttttggatgcttaatgtttttatggttatctggttgatttcttctcttggtgttaaacacatttcgtctttagatctttttctcccctaattgttaacgatatgtccagtaatgtatcctagctccaatatccatattcactttttgattttctttttttcttttttgatggagtcttgctctttctcccaggccagagtgcagtggcgctatctcggctcactgcaagctccacctcccaggttcacgccattctcttgcctcagcctcctgagtagctgggactacaggcgccagccaccgcgcccggctaattttttgtatttttagtagagatggggtttcaccgtgttagccaggatggtctcgatctcctgacctcgtgatccccctgcctcggcctcccaaagtgctgagattacaggcgtgagccaccacgtccagcccactttttgattttcaaagagtcagagccccaaaattccatctcttccttgcctctcatcgtagggttcacattcatgtagccataatggatcaagagacattctattctttttattgtggaaaatttcaaagttatgccaaagtagagggaatagcataatgaaccttctgtacccatcacccaactgtgacaatgatcagcatactacacattgcacaaatgtttccttttttttttttttaaccttcttttttttttttttttttttcttgagatggtgtcttgctgtgtcacccaggctggagtgcagtggcgtgatcttggcccactgcaacctctgcctcctgggttcaagtgattctcctgtctcagcctcctgagtagctgggattacaggtgcctgccaccacgcctggctaattttttgtatttttagtagagatggggtttcacaatgttggccaggctggtctctaactcctgacctcctcaggtgatccgcccacctcagccccccagagtgttgggattacaggtgtgcgccaccgcgtctggcctctttctttcttctattattcagcttcatcttttacatttagatctggtgagaatggaaaatggtgcagcaacttggaaaacattagtgcctcaaaatgttaaacacaggcctccaacttctccacattctggccaacacttgttattgtctgtcatttttattatagccacctcatcagtgtgaagtggtatctcattatggttttcctaatagctaatgatgttgagcatgttttcctgtgctgactgggtatattttctttgtagaatagagtgatttgtctttttattattgagttttaagagttttaatatattttgaatataggtcccttatcagatatatgatttgcaaataatttcacccatgttcaagtttttaggcaagaatgctttataggtacttcctgtcacatcagaaaagataaaatcggtggtataccagagagtagggaggcagtaggcatggtccttcccagatgcaagcaataggggtatattatctgtagagaatttgaaaataactaaaagccatactgctttttattattcccattatctggcaattctaaacaatgttagtgatggaattccttccctccaggatggaccacttcccctgcaccacccttttgtacactactgcccagaacatctaatttttctgctgtcagtaatactcagctcagttggtgggttctgggagcattgacctgatcctttcattatacagctccccatcaccacattttctaatggttgtagcatcagctgacaaccttgggctaaattggttacttagttcagggttcaaagtggcaattttctaattttatcattcattcttcacgttagctagaattattttataaacaattttccctcgtgaaccatttggtttctctgaaatataattctcacagaaagtgattctttaaatgttagggttatttgagttttgtctataacttgctgatttttttcccagtttgtcattcatcctttgaatttgctgtggtgtttttcatcaagcaaaaggtttatatttttatgtggttaaatttattaatcttttattgctttaagatttttgtatttagaaaaatactgcccattctcacattaaaaagaaatcacctattcttctaatgttctatggcttcatcttttatatttaagtctctaaatagtttagaatctatcctagtatctgaggaacaggtccagctttctgttttttccatatggctaccaaggtgttccattttttccctttttaaatagattttatattttagagtggttttagattgacagcaaaattgagcagaaagtagagagagttcccattacctcctgcctcctcatatgcacagcctcccctactatcaccctcctgcactagacggtacatttgttacaattcatgaacctaccttgacatatcattatcacccgaagtccgcagtttatattagcattcacttgttttgtacattctgcgagttttgacaaatgtatattgacacatatttttcatgtagcgttaccaagctagcaatgggcttgctgcccaaaaagcatagacgccaatactatgccaccagcttttgtgaaaagaaagactttattgcagtttgacgggcaaggagacaggaggcagtgctcaaatatctctctcgagctgggggctggggcaggattcatagcagagggtaatgaggcatgatctgattggatcttataatgcagtgtggccgggagacatgataggactggatcatgccatgaggtgtgtagttcttaatttggtccctgttccttgggccaagcactaaggttccacccatggttgcatgcttggttcatctgggcatgatcaggtgatgtaacttgcaacctgggttacatgataactgaaaaacaactcaccattgtattatataaagttgaaccagattgggctgattctgcagttacaacagtatattcaggagagtttcactgccctaaaagttctttgtgttctgcctatttatcctttcatccctcctccctcctctgtatactgtggcaaccactaattttttacccatgttagtagtttttaccttttccagaatgtcatataattggaactatatagtatgtagtcttttctgattggcttcttttacttaatgatatatatttacatttcttccatgtgttttcatgatgtggtagttcatttctttttggtgctgaataatatccattgtctggatgtaccacagtttgtttacccattcacctgctgaaggacatctatgttgctgccacattttgacaattatgaagctgctataaatatccatgtgcaggtttctgtgtggacataagttttcagcttatttaggcaaatatcaaggaatgtaattgctggtcgtatggtaagaatatgcttagttttgtgagaaattgccaaactgtctttcaaaatagctgtatcattttgcattcccaccagcaattaacaagagttcttagcactccacagactagccagcatttggcatcaaacaccatttattttaaaagttcatctttctcttgctatttatgtaaaaccttgtctttgttatacactacatttttatattcatttgtgtctgtttcaagattttctgttttgccatttgtcagtcaactcatacacaggtactatactgttttaattatggagcctttatagattgttttaatacctaggagagctactctctgcactctgcttttctgtttccgttttcctggtcattcctgctggcttattcttccatgagagctttaaaatcaaattgtctaactccagattaaacacacacacaccccgtggtctttttattggaactaagttgaatttataaactaagggataactgctatctttaggattgagttttcctttccaagaacatgggatatagttctgttttttaaagtctgcctttttaatcttacttatcaggtctttttttctctcttcacttttatgttacatgtatctcgttgagtttatgccttgttatttttattgtttataaatagagtcctctcctccattatatttttcaaccagtcactgtatatacaaaggttattgatttggtattcaattttatatactgtacctttactaaaatgtcttatttgtagtcattttaaaatttcctttttaattttttagacatatatcctttgcaaatatgaatagttttagctcttccattccagctcttgtgccttttaaaatctcctctagttgcattagtttatatgttcaatacgatgttaaatggtagtggtaattatcctgactctattgggaatgccattaagtaacagtccttggagtgtgcacacacaaatatgacgaataagctattccagtgtgttctatctttaaagaaaagataatgacacatagcatgtttggagagccagcctatatgtagttagcttgaataaatctgggtttctcaatgacaaagtacagggaaatacaaatgtctaaatgacaagtctgaagcatcctttaatttctactgtattgggtgttgagtggtttattttttaaatcatgggtgactgttaggtttttgtcaaataccttttcagcatctgaaaatgataatatgatttttctctttacatctattaatatgatcaattgtattacttgattccttaatattgagccacccttgtgtttggtcctaatgtattgtttttaatatgctttcagattctgtttgctaatatttatgatgtttgtctctatattcgtaaggcagatcggtcagtcatgttcttctttttaattgctttttttacattattaaaattatgtcctaatatatcaaagaccatcaaatagtccctctcatgctgtgagatgccaagtctacagcccaggtctacaatggaactttgcacttatgtttgtccttctgccccttaggttataaacctacctctctgtgcagcattccaaagtgcctcgaatcaatagaagacatcctttctctttccatagctgtgggtccagggcttcaacttctaaacaatatgtttccagctgaaaacccatttaacccagagcaatgctttccacagcaagagtgattcatgtgaagcttttcgttaatactctctttcctcctgcacaagaggaggaaaagagaagtcaatactatctctttccttctgcacatccccacaattacttgcaaccccacagtggtggcattaattttatcttatggagacattacaatatgttttaaatatttcattactttgcttaaagtataagtaaataaactttggcagcaatattaggataagaagaaagggttcaaacatgcaaagaaaagccaaagctcgttattttaatgtagatgcccgtgtggattttaaaccattttctaatttaatggtcctgttagatgtgcttaaaattagaccaaatgcatgcttttaataaaactgttactgcttccatccaaactagaatcttatttcctatttgtctcttacagaggacataaagataagatatttgtggtaaagtgtaacccacaccatgttgacaaactggttacagttgggataaaacacatcaaattctggcaacaagcaggtactgtcgtttgggtttatcatttatgtgattgagagctttaccctagctggaaagaaaaacaaaacaaactgttgctactacctcgcttgtctctgcaatctaaaataaaaatgtgcctaaaaaaattatctcccaagttcgcttagaacgcttgaagcttagaacactctatatgacgctatgcatattcatcaatacctagaaagctttggaaaatgttctgctgtgaaaataatcatttttatatttagtcatctgttctgaaagcagtaattatgttagactactgcacaggaaataaaataatcattttggttgagtgaataaaattttatctatttggatggttcctttatttatctattactgaatttaaacctgaattaaaccctgagtctgcccacaaataggtggtccaataaatattggtggatttaatgttgataataatgatgagtaaataagcatgagaaaacatagaggatatctcattcttctcactaataagtcagacttaatacaattgaatctgaattcttagtatcagctttggtgccaagccctaacttattatgcacaaaatgtgaataaggttctgttccagtgcattttgcttttaaaagaaggtaatgccacccagtatgtctggagagccagcctgtgtgtagctgtcttgaataaagctgggtttctcagtgacagggagtgtggggaaatgtgaatgtgtaagggacaaatctaatggcttgtcccgtatactaccttttcctacaaaacaattcttttttctcaccccaaaatagctgttataaataagcagagcatatataacatgcttatattttacatttacagtcagtactatttttatcgtttttggtcagcattcatgaagactttgcttgctccttcaggcacttagtcactctttctcttggctgacacagaacttgtgctgagcctcagttagacgcatgtcttggactgagatgcatattgattgctctctccagccagactctgagttccttgaatacaggaaccctcttttcatcttcatatcccaacagtgagcgctgcacttaccacatgtagggattcagtaaacactgagttaatgaataaatgagaaatattcttagaatatttttgttcatgatgttctctgtcacttttagacatctttacataaatacctaatgagagacaccaggtttctcatggaagtagtccttctacatgcttataggaagtgccagattttataaagtaataactgttcttggtccactctaggtgggggcttcacttctaaaagaggaacttttggaagcgttggaaaattggaaacaatgatgtgtgtttcttacggacgaatggaagatctagtgttctcaggagcagctactggagatatttttatttggaaagacattctactactgaagacagtgaaagctcatgatgggcctgtgtttgctatgtatgcactggataaggtatggcctgtgtatcagcattcattttcctcatcagccttctaaaattataaggtagtcttaggatggcccaagaggatgcctgtatctaaaacaggcctgtctgaattaggaagtagttgtcataaagctcagtcaagagacaatagggaggaaagcaaagatatttttataatttcgtttacagttgtttctttatatgcaacttctctgcactttttccacacatgctcttcctggcgcccactcatgagagtcccttaagaagtgccaggataaatgtggacacttagcagcagaagagtcctgagaaatacttcagcattgtcttcctccttggtgacacaatgggcagagacctgaaagtaccaaatggttacattattgttccagacgtccatttgctacgataaatttgcatccataaccaacttgctcctgtgtagaaaggctcagctttaacaagagtgttagagtgaaggctgttcattggccatattacaattcaagctcatcataattgccctggtctgtctacttgccttgcagtgtccctctacaaagattacacttaccttctctcagtctgtttttgctgctgtaacagaatttctgagactaggtactttataatgaacagaagtttattggctcacagttctggaggctgggaagtccaagagtaaggggctgcaacagggaagggccttcttgctgtgttacccaatggctgaagggccaataagagtgggagggtccgaaatcatcctttagtaatgaacccactcctacaataatggcattaatccattcatgagggcagacccctcatggtctagtcaactctgaaagttcccacatcttagtactgttacagaggcagttaaatttcaacatgagttttggagggggctaatatttaaaccatagcaccttcagtgttttaaaacactttattcaatcaacttgccagcaaatatcaacttcttttcagttatttccaggttgctggtagtaccacttcatctgtgccctctgacctccagttgaagccacctactactcctaacccatgtctcaattttcttttacctgtccttaggcaaatgtgttgattctactacaaaagtaggttcttgttaggtatgcaactgtaacggttgttttgctggcaaaggtgttgttttgttttgttttgtttttttattggtacatatgtttttggttaaactgcaagtattagaaaagattaaagaagaagaaagaatttctgtaggcccagaagtagatatggtgtaacttgtttaagctcttgttgtttggtaaattaagctgcaaaatcatgagaaaagacaaggatatcacaatataatatattgcattttaatttaatttggggattgaattttcctgggtacaaattctatataagaataaggatatttagtgttatacacttggaaatattatttctttgtaaacttcataaaaatgcattaaattaaaagttgctaagaaagcagtgaattactcagcttttttcttagaaaaaaaaaaaaacctctaagaacagttggtatatataataaattaccagaaaggaaaactagtacagccaaaaaattataagcttagaacaggaataaagatcactgttcagtaaaaaatatccaatatgttaagctttttactttccaggtttttgtaaaaattaatctggattttaattatggaaattgtgtctattgaatgaaataggatcgtttcattatataaagtacctaagctactcttaataaataatgatgttttcttctggacatgacttttatttttaaatgtttaacaataattttaaactgtgatgttaacttcaatccatttggtcagagtatgtgagataccagaaactctgctaggttttgaggctggttccattctgtaggaaccacattctggttgggagactgggcacaagcagagccatccttgatcagtgggccagctgccaaccattgttctgaggagagtgcagtggacacatgctgagaacgtgcttaatcttgcttagggaagtatgggagaaatgctcccaaaaaatattattcgaacattgttatcaccagagttttccatctcatatatttaggaaggtagcatccacaaagcttccttacctgcggggaatcctcctggggccaagtgggtaattggtcattttgatgtgtatataatacctctcatgtgtgccttcacagggctttgtaacaggtggaaaggacggcatcgtggagctctgggatgatatgtttgaaagatgtttgaagacttatgccattaaaagatcagcattgtcgactagctcaaaaggtgccactcccaaacatgtaatagagatctttgtattcatagggatggagaagattgtactaaagtttttagaaaactattagcaaatcaattttctccctcttccatgtttagaactctcttcctctggtagaaatgtcaaggctgactgcctagtacctagttctttggagctataaaaattgaatttatactaataagcagttgtttttgttattgtgttaaatataccatccccttccccaggcttgcttttggaagataacccttcaattcgtgccatcactttgggacatggacatatcctggtgggaacaaaaaatggagagattctggaaattgataagagtggcccaatgacactgcttgttcaggtactgtttgtatgtattctaaactgcagttcacatcaaggctgggactagagtgaggcaaagttgatgcttaggttgcaaaacttaaggaggcactcactctcagggttgcacaagagttgaactagttacctattgctgtgtaacaaattgccacaagcttagcagcttaaaacaacacacatttattttctcacagtgtctgtggatcaggaatctgagcacagcttaactggatcttctgcttagtgttttataaggttgcaataaaggccagggttatggtctcatctgaggctaaactggggaagatttttccaagctcactcatgttgttggcagaattaagttgcttgtaagtgtaggactaaaggcttttttttttcttgctggctgttggccagaggccattttcagctcccagaggctgcccacagttccttgccacatagggtttcccaacattgctgctttctcaaagccaaaaacagaggggaaaaaaatagatactacaattttatgttacataattatgtcatcacatatgtggaatcataacattccattgcctttgccatatgctgttggttagaaacaagtcacaggtcataccacactcaaagggaggtgattatgcaagagtgtgaaaacacaagaggagtatgagggtcaccgtcactggccaccctctggccaccagttattcatgtccctaccacatacagaatcctttacctccacctccaaggtccccaagagccttatcacattacaggatctgctcaaagtccagaatctcattatctaaattgggtccaggtgtggaagaagtgccttagatgtaagtcctgtcaatctgtccgtccataaaatgaacaagacaaattacctgctccccacatgccagatgcacctgtgcccctttggaatgtgggcctcactatagtctcagccttggtccacataagcaaattgcatcctccttagtccctgtcttccctcaaaagtcatatttaggtaaaattgaactaaaataaatgtaacagaaccttttaggagccaagaaatgataaaatctcacctcaaggatggggatgtggtaggatgtggaggtgcgttaggtagtcctgcccagtttggtgatggataagaccatatttaggtggaagaggcatggtgaggggtgaaggatgtgtgttcagaagttggagagaaaagaaaatgcactgatcatatgagcagtcagaacttccaagattccagtgcaggagcttcccctccttgccttgatctctgagtgattgatgcctgcaggcttgctgtattacgagtgaatccccaaatcccactgagagggtccctctgacttactgtatcatggaaacacatgtgcatatacactatggctcaggacactgcaaggctttaaaaacacaggtgcccaaatcccaccctggatatcctgaacaagtctgtgtttttaaaagaaaaaatctatgttaaaaacaaacctcgaaagctctgcagctggtcgtgccttgcagccaggctagagaactaggctggagatgcatccttgaggcaatgaggtctttgttctccagctgttcttgcttttgttgttttcttccaaactaaatctttttttttctggccataacttctaatttaattttactgaaaagtatttatttactttttaatctccaaatgtttgagaatgtaaattgtttccatgtatgctatattgctagatattttagaagatttatgccccaatatgatttaaataatactgtaagatctaaactttgttttctctcttattttgttacacttgaggtagtttggtttaaatatgttttatgcttgaccaaggcttttcacttcttaattctctacaattctattctttcctatgtttgtttctattgctctaataagaaaaataaccacagcaatcatatattgagcacctactctgtgtcaggcaataccgttgtacgacatttgtctcatctccacaacagattggctctgttacattgttttatagatgagggacctaaagcccagaaaattacccacagtcacatgctaagaactgcagagctgggattccaaccaaggtttgccagagcccttgttcacctcaccaggctgttccccacatctcttagcttggacacttcaggaaagcccctgagctatggggtggctggttgagctgctggaagcttcagaccagatgttagttaccatctttgccacctacatgtgtaccattctctcccttttttttttttcagcatctttttttcgtcttctgctctctcatttgctatttcctcttaggtggatctcattatttcagttcagtcaatgtttgttgggctcctgcccaggtctgctctgtgctgtgtatatgtgcagtggaataagggcttcctgcttgcccaggaccgtgtcacagtcctgttctgagagatgatagagacagcaagggaaagtgaaggaactgtagaggcagtgtgagtgagacgatgggctgtcctgccggaagaagattttagatccactttgccggttttggtggcacggcaatccaatcacagttggaatagactgcttattttttaagagaaaataaggttgggggaggggagaatggcaggtgatgggttgtggcatttcccgtcatgtgtgctttgaagcagtcagctcgcagttgtacagctgtttatgatcagctttgtgggtgatcagcagcaaagcaggatcctaagcccatttccttgagccattcaaggtccttcaagcctgcctcgcttactgtccgatcctgtgttacacggggattaaaataaacagattaaggaaatacaattttgatgtcaatataaggcagtggtttaaaaggatctctgggtcccacaatcttgttcttaactaaaatacacaaaggggctcagtctatagaagagcttcaagcagagtcagtctgggaagatgtgaggttgacccctgagctgtaccctgactgtgactctggggctgggaggcttccaaagagaaggctagaaaaccggggatgtagggtgtcctcaaatccaataaattcaaaaacaatgtctgtatccttcagccctcattttctcatatttgaatgtcagttgtatttggaactttacatcttctgccaaattactgttttgctcaaatagcttctcagttaaattggaatcatccaatttctctttggaaagccacctgttccccaaagcattccagctacaaacacctttcagatgcctgtgtgtgggcttcctttttgctttactaagcaaagcctttttgtaattagccattaaaaagccaaaattcagtaaacagttaatctggtctgttttattgctctgtagcactaatctttacacactgcattatagagtgaaaaattatgagaatcaaattcattttctccctgttaagtgttcgttataaaaaaatactgctttctcttagttattattctaagccagccaagtgtgtttgtgataagatacagatacatggaattggtccagtgcttattaagcacctttcagtttttgatgttcattgttggcacatggacagaccaatttgtgaacagacgcagaacctgggctacaccgaggacgcttgaaatgaaaatttagcttcctttacttctgctctgccgaatgctacacattcaaaggactaaaattgcataaataattagaatattgctcttcaatttcactgacatgaatgggtcgtacctgcatcttttagaatatgatttaactgaaggaagtggtttgtgtccttgtgattaagctgctttactaggagggtacatatatactatgtttatttagtatgaaacaacagaaaagcaggcatttcaccatttacctggatgtttctaaatggaaagatgtttggcatcatataaacaaaaccaataagcaatgagttcatgttttgctttgcaaatgaatgatttagcatcgtgtaggtctagctgtagattcaagtttaaatgaaaaaattatttcgggtgatgattttggttcaaggaagctcaaagtgtgtttattcctatttgtgcttttttgtggtactcttggactgaatatgtagcaccaggctaaagaagggctagccaaacagcataagtagagtttatgttgccccttttcctctcccacaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtacataacaccaccttacacatctgtcagagtatttacaagtaacagaatgtgtcatatttattcactcagttaatatttactgagggcacgtgttatatgcccataaatatgctgggcaatgagaattttatattggttgctacagtcataactaagcacatgtagaattatgccagaaggctggcctaatccagctccatttttcacttcattttccttgcactgcacagatatttgccacctgggggcaatatgtccttcctcttctcattgagagctgtgggagtcaattgaaattcatcagcttttaaagaatgctatttattttgtaacagtctccagaacttattttatgacttgaaaacaaacatcaattatatagaaatataatacttaagaaatgagtaaatatgtcttgaacacctaaatgcactagaactatgaggtgtactgagaggtacaaattcagcaaacatttattaagtagcttctgtgtggcaggcacaggggatcccatgatgaatggtcccatctctagtgtcagagatagacaggacttgaacagagtctcagcaacatatccattcaaattgggtaattcgaggagagtctttaaaatgggactatttatataaagggatggggaaggtatgaggaaatgaccagggatagtgcagcactatgcagctagtaatggcggctgctctcactggccctgggcttgaagggacaggaggagaggacaattgctgcaaccttgaatatgagagccacatgagatggcagcctgagagaagccacgactgatagcaggggactctgccagcatgcagtgaccctgcgggaggcagccagggaaataaatggcccggcctccctattcttcctccatctctctaatttcccaccagtgctccccgttggccaaagtcaacctgaaaccagaggacaagggagcccattgatgctctccatgcagaccagcttcaggcacagagcagggtggacaagggcaaaaaggggatgtgaaaggacaaactaaagatatttggcacaaagtaccctggagcctcagaggacatctactgcttggaaatgcttcatcagagaggtgacgagctgaggcttgaaggatctgtaaaagttcttaagagggaaggatgaaattgaggtctgaccctaaaatatttgtactgagtaattttataagcagacatgaggattgtattctagggtaataaaatgaagaaaggtgtcaaaacagtagtaacaatagtgatggtggctaatatggctgagccaacaactatgccagctctttccatgtagtctttgtaggaaccccatgagtaaggctattattattgccacttacaaatcagaaaactgaggcacaggaagcttaattagtttgcacatttagtaggtaatggaaccaaattcaaacccatgcagtgtgactgtgagaacacacctgtggccactgcttaacactatttccctctgccgtgttgcctgtctttacactaggctcctggggattggtaaatggtggaggcaggatttcccaaatctaagtccaaagcccatgctcgtaatcactacaggctagaatcattttggctactagtttatatcgggggaatgataggccaagtcctcactgtgaaggacttgaatgtcagtgaatggactttattctctaagttaaaaattagttgaacaactattgacccatcttagataggataaccattcaacccagtttacccctgttgttctggtataattattaatagctttccttttcactctcaaacgtgtcttggtctgtacgatagattgtgattaacctaatcttgatgatgctcttcaagggcaggcttgtattttcattgtctcagtactggcacgtcagttttgagcatgaacacagctttcagcataccatgaacagaggagttggtaaagaggctcggtattaaatgccctggcacaaggccacctggctgtcctatccctggggtgtgcttacaacgctcgacaataagaatggtggcagagggtaggcatgttcttgaatcagtttccttttagacatacctttgcaaagtccatgctcctgattcagaaatgtctttgtgaccctacaaaggagtagagaacatggttcatggagcaccatcaccctagtgccaattagttttccagaaaccccttgggagaatgttcagattccattcttcgcgtgacagaagaggcaagaacaacatctttcacctctagagttatacattacaatccgtggatcagagaattggagcaactaaaagaatgaggtcctctaaagcaagttgtatgtaaggcttaatatttaaaaaaaatggtttctggaaattttattatagaactcctattcttaaatattacctcttttcttcgaagcaaagatactggtcctattaaccctatactccttttctccatttaccccacttattttttggaaaccccaggtatttaaatactcataaatgaatgaataaacctcatggaagttgaaaatgtatttttgatattatgatctttttccttggacttggggagaagagatacttaattttattttcttgagacagggtctccctctgtcatccagtctggagtgccatggcatgatcactgctcactgcaccctccacctccaaagctcaagtgatccttccaccttgcctcctgagtagttggaattacaggcatgtgccactattcctggctaatttttgtattttttgtagagatgggattttgctgcgttgcccaggctggtcttgaactccagggctcaagcaatccacctgccttggcctcccaaggtgctgggattacaggcataagccactgcacctagcttatttctttactttttgtacagggtgggtttcgcctctacaaaaaataacttttcaactaatttttaacctacggaatgtggcccagactggtctcgaactcctgggctcaagagttccacctgcctcgaccttccaaagtgctgggattacaggcatgagctgctgcgcccagacaagaggtgtcttaaattaggaagttttagttctcacaagtgtagtgtcaatttaaaggcagtcacgtgtccatacataatgcacatcatcagatttcttcatcttttcatgtggtttgcttgacagtgaagttttggataataagtgttttttgtggattcttctgtaggtggaagatgctgtgccttttcccctgatgggaaagccttagcggttggcttgaacgatgggagtttcctggtggtaaatgctgacactgttgaagacatggtctctttccatcacagaaaagaaatgatctctgatattaagttttcaaaaggtgaagatgacagcagatactttttaaaatagcacagtcttgggacaaaaaattacaagaatgaactatttcaaatgtttctttgaccattttcccacttttaaaatactaagttcctggaagtaaattcctatataaaatgcttcgatgttaaccccacatttttcttaacagatacgggaaaataccttgccgtggcatcccatgataactttgtggatatttacaacgtacttacaagcaaaagggttggcatctgtaaaggtgcttctagttatattacacacattgactgggactctagaggtaaagtatgttgtggcttttaaaatagaatttctgtgtttaaaaaatgtccatttatgcattgtttctagagagaatggcagttgagtgttagaaatgggaaaggggaatcccacaacaatataaacgactgtaattttacaacccagaggcagctgctgctaacattttgaatactttttccatctttttacgcttaggatgattattgtcactattgattcaagccattgagttttaagacagttaaagatacatgatgccttttgttatcatagcaagccaccacctcacctttagttgggagtgctttctccttgtcttgggtcccctcatcctcctcctggctggtttcccttttccacccaaagctccacctcttggagaaccgcccaaaaaggctcaagcaaatttcctcctccagcagaggtagaaatctacattcagcctgcctaaaatttctctgctctataaaactcccaacctactcctacctcctccaagtcatgcccacaaatgccatgaggatttgtctatttaataactctagcttttatggtgttgcatagtcttaagctagcaaatgtggaggctctggaagtgagtaagacatggtttctgctccctgtggagtttataattgagtgagggagatacttatccataaataatacaagagcacaaaatgggtaccgtgtgagtaagcagtggtgagtcacaagggaagtggtgagcagggactccgaatgggccacggcagcattcagtacccagggtggaacattgcactatagggtgagtcactcgtaaatcctatcctcaagactcggctgatgttgagagtctggagcgggtacttgggaatggacagcattcccaccttcagagacgttgtagtccactgtggtagagaagcaccaagcccaatgtatgctctgagggaaagctccttggaggtaatccatggagcctctgtagaagggagtgacctttgaggttgatcttgagagataaggagaaatccaccagatagcgctatcaaggaagagccattccaggcaaaaggaatatggcatatgaagagtgaaggtgggaagaaccagggggtgatgaagaaatagaagtgctcagtggctgagggtgtgaagggaggggaatgtggagacacaggctgggatagagcagaactttcatgctgaactgtgtacttgtaggcactatgtaactctgagggatctagcgtggggcattccctcccatcttggggagaagaagtgagcctggagttggagcaatcaaattaatcaggagaacgatgatgaaggcctctgccaaaaaggttatttcagagtatttcttggagtagtggccatagaccaggacttggaaacccttctgcctggcaggtatttagttgtaactatacttgccacactggaatttggactttatttcagctttacaacattcaggagttttatacggtgcagtagatagagaaaaaagcatgtgatgcattgcatttataaaaggtacaagtcccaacaagggcaaagggagatcagataagtctgtttcgctttcatgtcagggcagtgctggccagacaaagtgccgagggctttgaccggcatttatgaccaggcagggcactgtgactttatctaggaactggtgaggccgatgaaagcagctgcttctcagacccttctttgatattctctgcttttttttttaaagcagtgatttctccctatttattatcttgctattctcttgccaggtagaatagggtctgattaactttatttagaatccgacacacacacacacacacacacacacacacacacacacacacacacacacacacacaaaatacctgatacaatacgtgaaatcccaccactcaatgactattagggattaaaacccattattgtttctattacggagtgaagagtccagagaaaagagggtatatatagagtaaattttgactgggaagatttcttaattattttgaattgtgaagtacacataacaaaaatgtaccattttaatcattttttaagtgtacagttcaaggacgttaaaaacattgacactgttgtgcaaccatcactgcccccatctcagaattcttttcatcttgtaatactgatgacattcccattaaatgataacttttcatttccccaacacctggcatctaccattttactttctgtctctatgaatgtaaccactctaggtacctcgtataagtggaagcatacagtatttgtctttctataatgggcttattccacttagcataatgttctcaagattcctccatgttgtagcatgtgtcagaatttccttactttaaagactgaatgtttaattttatgtatagactgtattttgcttatctatttgttgaggggcacctgtgtggctgccacatttcagccactgtgagtgatgctgctatgaacatggatgtacaaatatatcttcaaaaccctgctttcaagtatttgaggtatatgcccaagggtgtaattgctgaatcatatggtagttctatttttaactttttgaggaattactatactgttttccatagcagctctaccattttatattcccaccagttgtacacaagggttcaaatctctccacatctttgccaaagcttattttatgtgtttattttgataatagctgtcctaatggatatgaagtgtatctcattttgggtttcatttgcgtttagggagtttgtttgttcttaattctgcaaatgtataggccctgtgtcagatggtggggatataaagagaagtaagtcccagatagaaagcacaagatctcggccaggatcagggggatgctgctgtggaggggcctgggggaaggtctgtgtaaagtccctcgatatggagccatcacttggtggaaagagaagcaaacctccctatttccataatcttgcccaaggccagcctcttagagctcaggatgctgagggaggctcctgggaatgagcaggagaggagtggagtcaaaggtctttgaaaagccaccatgcttctcattgtaagggtccctgcaggcaggtgagggggtcagaccaagtgctttctgtggattgagagtagtagagacacttctgatttttagggaggaattacaccatctggagaataagagcaagaatacctgtgaatcttccttgatctaactccactagccatgagacatgtgtcatcctgatattcctgcattcccaacacctcagtccccaaaatgcctgatctcgagaatgtgccatgctgcctcaagaccagcctagctttcacagcaggggcctccagagtctggcaaggttgagagcagaatttagaagcagggttctgtttcatgcctttgatcctgtcgaaaatagtgaaagcatttgccagagccagctggcttctcagggtgggggatggcacagccgccagcctcagcagcctcttgtgcccatggcaactacaggtccttggaaaaccaaaaagtgcactgggcttttgcaggaacatcagctacccctgaatgaaagctccagcatggaatgcttgagaaagaaaaaatgtatggagggagagaaaacatagaaagggtattttctaaatgctacaagttcatttctagaaatatcaggctataacatcctttacaaattaacaatttgaaggctgggtgcggtggctcacacctgtattctcagcactttgggaggctgaggtgggtgacctgaggtgaggagtttgaggccagcctggccaaaatggtgaaaccctatctctactaaaattacaaaaatcagccaggtgtggtggcgggcgcctgtaatcccagctacttgggaggctgaggccaggagaatcgcttgaaccgggaggcagaggttgcagggagctgagatggcaccactgaactccagcctgggtaacagagcgagactatgtctcaaaaagtaataataaaaatgacaatttgagccataataggacatttcattcccatttttgttgcagatggcctgatacttggtatatttagtaccagttgttagaattattctaacttgtaaattatatagcagctgggatgatgtatgtggatcactttgtgggctgcaaagctctatggtacccgcaagatgtgtgatgtaaggacatgggtgtctttcagtttttaatctgtgtgagcagatatttccagtgaataaaaatgtgattctgaaaggattactgttattcaagagcaattataaatgcaaacagagtttttgttcttgcttctgctcctcatcctcagaatatgtcagtggtgagacagatagattagatagattagatagattagatagatagatagatagatagatagatagatagatagatagataagatagatagatagatagatagatagatagatagatagatagatagatagatagatatcacagcaggcagagagaaaaaggagtggtgacctaaatatttcctcatgcttaagaaacatgtattagcagcagtaaagaaaattttggttttaaaaaaatacccttaattattcctttctaatagaagaatagctttttggtttggttttttcttcttgacatccttgattgcaaagaacagaaacccactcaaaccagcttaaacttttttttttttttttgagacagggtcccactctgtcacccaggttggagtgctgtggtgcaatctcagatcactgcaatctgtgcctcctgtgctcaagagatcctctcacatcagcttcccaagcagctgagaccacaggtgcctgccaccatgcccggctaattttttttctgtatttttagtagatatggggtttcaccatgttgcccaggctggaaaccagcttaaattttaaagtaataataacagatgagtttattggaaagatacggagatattttatagaatccaagagcaggaaagaacacctgccaaggaactgagtttagcaatgaactagaaaacgcacaggaaccaagcaagcagttcctctcccctcctctcccactcttaggcagctagtttcagcatccactgctcttctgggtcttatctctgcctttgacccctctctctgcacaagcagcctttctctacttcatctgcacatggcccagcctcggctgccccaaaatgccacccacaggcccaaagtccacatctcatccctgtaggcaccaactgattcagcctctcagattccagtttaccaagagagaactttgattacccagcccagtgtgagcctggcccctccaggatcaacatctgcccgcagagtataaacatgaccgcgggggcagttctcggggaaggggcatgtgctagataggggaccctacaagctgtctacaatgctacacagcacttacggtacttgtctatgtgtttagattctcgaatatttttgcaatcataaattacttcactgagagatttttctcatttttggttttaagtgaagtatgatctttgaaactatggtgtaaagtgagttgttgggatttatctgaggattacagtcctctgaattatcttagtatctcatggccaaatatcatctaaaattagccatattcaaagaatgtgttcactgaataaccgtccacgtgctttgtcatttgcaatcactcttgagtgtcctaaaaatagaattactttacagatgtatttagttcatcggaaaagtattggttactcattttcttataattctaaatagtcaaagataactaactcccttttttcttttctcacttacatatattcagccataaagtcagaagatgtgcccatttcagggtacacattttcagatatatttgctcaagtcaaggaaaaatcccctaatcactgtgttataattcaccaaattagaaatgattaaagttgtcagtttggaaatgagagaaccttatttttagtcaggtagaagtagatctacaacttcttaagattagccaagctaggctgagcatggtggctcatgccatataatcccagcactttgggaggccgaggtgggcagatcacctgaggtcaggagttcaagaccaccctggccaacatgatgactctctgtctctactaaaaaatagaattagccaagtgtggtggtgggtgcctgtaatcccagctactcagaaggctgaggcaagagaatcgcttgaacttgagaggcagaggttgcagtgagccaagattacaccactgcccactgcactccagcatgggtgacagagcgagactccatctcaaaaaaaaaaaaaaaaaaaaaagattagccaagctagatttcagatcaaggtggtgcctatttaaatgctaaagaacacgatctaaaccaaaaagttcttattttggtattatttttctaagaaagatatttcaaaactactagatatacatagttatgggaaaaaacaaaaggagaaatattatgtatatgtatactgaattatttataggtgaaatattatgacgtctgaaatttgcttcaaaataatctagggtggaggttcatgaaacagggttggccatgtgttaatagctgttgaggctggacagtgggcatacaggggttctttatactcttcttctatacatgtttgaaactttccataatatttaaaaaatggcaaaaatactggaacataaataccttgagtcatttacattttaagccttacaagattgttgccattgtaggaggagaattaggaaatctaacctttttcaacgtcaaatccaagattataattgtacatcagactgaaagactatttttgcccaacattttccttggggaaagtcctggatttcttttcaaatgttcaagtaagaccagagggtggggaaggaatgagcatttatagtttgtgtgttctgtttctaaactttaaaggcaaatttagaactcagtcctaagtaaatgtgaatgctcacagtaagtgttttatttctaattgccataatcttccaatgacataattcttgccaacacagtttgctgagaggcaactgggaaaaacagggggaaaactgatttttctcaggctttggaaaactatattttcagtgcagcatatcaataaaacatatcaagctttattcttctgttatttgaaggatgttgaagatcaaatattatgaagtccatattctaaaaatcacagctttggggtttgtaccacatcatgtaattggctgtacatgcccttctgaataattcaaaatgtatttactcaatttgtgagactttgattaaaatgaatcaaaatagcacccatgcttctcattttataataaagagataaagtcagattttaattatctctctacttcgttctgtcgtaacaggaaaattattgcaagtgaattcaggtgccagagaacaacttttttttgaagctccaagaggcaaacggcatataataagaccttcagaggtaataatcatacacaaagatttttaaagatattttgtgaagatttaatatgtgcattttaataaaacctatcacgttaaccactaatatgggttatatttactatacctttaagtttgatcgtgtcttcaatctgattgcttaatctggtttccaggttcccagaacatatggatttatcacaccactggtgtagcaatgtacagttggtgctctgcttaatttttctctgcctgaagacaatgaataagctagcaatttggatgttatatattcctttttccatttgacatgtcattttgtgcaaagctttttatgaacatatattttgaaacatgttttctcaatggttatttgtaattatgaacattattatctataacaacagaatttttttttttttttgaggtggagtcttgctcttttgcccaggctggagtgcaggggcaccatcttggctcactgcaacctccccctcccaggttaatgtgattctcccaccacagcctccctaatagctgggatcataggcatctgccaccacacccagctaatttttttattttatttttttagtagagatggggtttccccatgttggccaggctggtctcgaactcctaacctcaggtgatccgcccacgtcagcctcccaaagtgctgggattacagacgtgagccaccgtgtccagcctggaaattattttttgagacaaaaacaatctgcaatctgaccattgtattgtatcaaactgttttcttttttccatgtttcctcatgtccttagctacatacacgattttttagttgctgaaatcaaagcctagataaaatttttgaatccctaaactaacacctcttgaaagctagatggcttttgtagatgcgtacctctttcagggtgtacacataatgagccctggtctaactgttgatgaggatgaggaaatattgcttccttagaggaaaaggaggtaagggtatgccactgagtggcaggcatctgcctctccctcgcttcagtttgccagtatcttaaactgtcccagtattgtaaggttctccctaagacatttggacacgtgtacatttgcattgtcattgtttgtaaaggaagtatatgtgtagtacttaaaaaatatacatcgttatagatcatggcattgtattaatggaaactgttcactgagaaatttgatctcactcccctccccaattccaatttatttgtctctgatccgtcctctttttaacttttttatatggagaaacttatggccttgagtaagaggtatttttaattacgtccttcattcactggtaatttgttgactgccagatactttatacacctttatttttaattttaatttcagctttgattttagattcggggatacatgcataggtttgtttcatgggtctgttgtatgacactgaggactggcatacaaattattgcatcacccaggtagagagcacagtacctagtagatagtgtttcagcctttgccacctcctctctctgccccccaggaatccccagtatctgttgttcccaccttcctgtctgtgtgtacccaatgctttattcccactcgtgagaacatgtggtatttggtattctgttcctgcgttaattctcttaatataatggcttctagctacatccatgttgctgcaaagaacattatttcattattttttatggctgcatagtattctatggtatatatgtaccacatttcctttatccagttggtcactgatgggcatcttggttgattccatagctttgctattgtgaatagtgctgcaatgaatatatgagtacatgtgtctttttggtagaacaattccttttctttggggtatgtacccagtaatggtattgctgagtagaatggtaattcttttttaagttctttgagaaatctccaaactgctttccacagaggctaaactaatttacattcccaccaacagtgaataagcattccctttactcttcagccttgccagattctgttttttttttttttttttttacttttaataatagccattctgaagggtgtgagacagcatcttgtggttttgattagcatttctccaatgattggtgataaacattttttcatatttgttggctgcttgtatgtcttcttttgagacgtgtcttttcatatcttttgcccactttttttttttttaagacccttttctaagggtcttgctgtatcacccaggctggagtgtagcggtaccatcacggctcactgtaaccttgacttgccgggcttaggtgatcttcctgcctcagtctcccgagtagctgggactgtagatgcacaccaccatgcccagctaattcttgtataatagttttagtagagccagggttttgccatgttgctcaggctggtctccaactcctgttgccctctttttaatggggttgttttttgcctgttgacttaagttccttttagattctggatattagacccttttcaggtgcatagtttgcaaatactttctcccattctgtaggttgtctgttttctctgtcgatattttcttttgctatgtggaagccctttagttaattaaactcatcaagtctcacttgtcaatttttgtttttgttacaattgcttttgaggacttagtcataaattctttcccaaggccaatgtccagaatggtatttcctaggttttcttctaggattcttatagtttgaggtcttacatttaaatctctaatccatcttgagttaatttttgtgtatggtgaaatgtaggggtccagtttcgttcttctgcatacggctagccagttatcccagcaccatatatttaacagagagtcctttccccattgcttatttttgttgactgtgtcgaagatcagctggctacaggtgtgcagctttatttctgggttctctattccattggcctatatgtctttttataccagtaccagtctgttttggttgctgtagccttgtagtatactttgaagtccagtaatacgatacctctggctttgttctttttgcctagaaatgctttgactattcagcctcttttttggctccatatgaatttcagaatatatacacctatattttaatcctcataacagctttacatgatagttgtcaatctggttttacagataaggaaactaaggctctgtaagggcaaaagacctacagcactgtgatcttaacccaaaggcatctatgtgtgactccatggcctacaccatgaagcctctcaatttctcctgtggatttaagtgtcatttcacatcacttcagctgtactttcccttccggttttagtgcccccaaataagtatactaaaatgaaatgtaatttaaccaaatggtagaggaggatgaggctggcttggaacagatgagcaattattatataaaagataatgcacaaaaggaaaattcatgttataatgcttcccaaagtgacaggctcttgctctgaagagttaagagttaatttgttaccctgtggtgcacatttgttactccagaggctgattcctgatgatgttggttgcagagtccttccaactgatgctttcttggccaacttccctagtagtgccgctactgagagcattgaagaggtagctcatcatgttagtcccaatattataaggccctttgactgagcatgagggattttggaaaatctttttcaaagaagcaatttttttttttaagaaacaatcatggtaaactaataaaaagcttacccagcaaattgttaaaatatgacaaatgttaaaatgcccatttcaaatccatctgatacaaatggtacagttaaagcagcaccatattgggaggcaaactctctggagcaaacctcccccttcggcttcctaagcatgctgtgactgcagtgatgtaacctgtctgtgggcctcagttgcttcctttgcaaaatgataacatgtctacctgaggcaaggtgctaaggaagggatcccttgaggactctccttccatcttagttccagcattttcaacaagtttatttaacccttttgcattgacggattataggtatcatttttaatgctccattttaagtgcaatttctgtagcttccagcaagttcgacatttgcttcccctggagaacacggtgccctgatctggccaacagtgttgtgttggggtgtctgccaggggagcaataccagctccctttcctttcctgctgggatgaggccagcatcactgtagggattgcgagtggactaggagagtcttagagatggaatctagaatttggaagggagtcaatggccaaaagcatgcttccagaaccagcaagggatggttccctgcttctcttcctgtgaaggttaggttaggacatcataaggggttgagggactccaattctaaaactgaggtgatttctgggggaaccaccttgagtcaccttggtctgtgttcctacccaaggcccccaagtcacaggaccagattcagatttttgtttccacctctgtgtgcctccaaaagaaacacacaagattaaatgagaaatttgagggactaacaaatgtatagcaccttaccacgttgtgactaaaactcctggctgcatctttatcttgtaatttctcttctaagcaataacaacaagcagaaattaggcagggtacattagcagcgtgcaaaacagtttcaaattcaaaaagagagatctgggctttaattttagctacagttctctaatttcttttactccagtgctttctctaaagaaactggaatattaaggtataatagcagatgttgaatgaaagtaaatgagataaaatctcccagaaagccataatgttgttgttattgtctattattgttttaagaaagtggaaagaaaaacctcagtcttatcaggatttaacctatacaaattacaaatattctagccaagaatttcagacaaaacagttttaaaggataaaagattcatggcaatagaatatgaatagctcttcagatttttaaagtagtctctctagagcatacaggatattaagcttgctgcagaatcttattactttttcctccaaggaagcagtcatgttttttaaagttgtgtcttgtaactttttaaaataattggctaaatgatcatctccattgatcagcctaggtcagtgattctcaactgagagcaattttgtttcccaggaacatttggcaatgcctggggacaagggtatgctactggcatccagtgggcggagaccagagatgctctaaacatcctgacacgcacaggacagtcccaacaacaaagaattttccagcctaagacatcagtgctggcgttggggaatctggatccagcttatggcttatacaatgataaatgtctagttaagaactaaaataccttattattatcaaatttccacaatttcaaaatgttcattttatctagagaaaaacatttgggtatttgactgcagtgttggcttctgaagacaatgcaaataaccactttaaatatgcaacttagaatttgtgtacctcagcactcaacacaaatgcctaacgttggcaaagtaatttagaattactcaggtgcaaactgtttcttttaaataaaacaaactaggttgtgcaaaaatatcattctctttcgttctttttcagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaaggtaatattgcgtgtttattatctttacttgctcagtctccttaataaccttaaatattgtatctaagtgcatttttaaaaatttgaagtcataagcaattcacattatcggagtattatttatgctgtataaaaacctccctgacattgtgtttgagtgactaatttcagtgcaattctcatggcatagaattctaccttgaaaggccttcagtggtcaccaaatccaacatctcacaaactgcaaagtaagtgttacctttacaacctcacagaccagtgcctttctaactttcattaggatacttccacagatgaggaacttaatatcacacagcaccccaactgatttttaaatacctccaattgttaaaacgtttttatctatcttgagctgaattctcttcttccctttttttttttgtttttttttttttttttgttttttgagacggagtttcactcttttgcccaggctggagtgcagtggcgccatctcggctgaccgcaacttctgcctcccaggttcaggcaattccctgcctcagcctcccgagtagctggattacagacgcctgccagcacgccagactaatttttgtatttttagtagagagagggtttcaccatcttgaccaggctggtcttgaactcctgactttgtgatccacccgccttggcctcccaaactgctgggattatgggcgtgagccactgcgcctggcctcttttctttttaaataaagttctaccttctgaaccatcattaaaccattccattcctctaacagccgtcatctgtagtaagatcacatttgactccccgaagtctcatttttttttccagcctaacctttctagttgcttcagccatttcccatattcgatggcttacagctgtcccctcccttaagcacagtccagtttatcaattcttccttcaactgtctagtctagaactgtattcagtgttccagttgtaatctgatcaggtcagagcacagtgggactgctaccttcttggttttgagttttacacttgtgttaaatcaaactaaaatggcattggcccttttggctgccacactacaaaattgaatcatagacgtcaatctcaaaaatgttcagattatccccaagcctgtacttacacaattgattttctaagatctgagtacagaactttacatttatacccaaagagttttatttatttcttctcagtgttccatcctatctgtatctttgaataccttgtcagagcattttctctcccttgcagcatcatgtcatcctctgctttcacaatcccgagttctaaatcatagaaaaaaagacagactggaacaatcacacgtcaactcaaggaacctccccctcaattcagttttacattccatttatttatttattttaactaatgaatgaatgaatgacagggttttgctgtgtttcccaggctggaatacagtggcacgatcaccgctcactgcagcctctaccttctagactcaagcaatcaatccacctcagcctccccagtagctgggattatgtgcataccaccatgcccagctaatttttttactttttgtagagatggggtctcactatattacccaggctggtcccaaactcttggactcaaacaatcctcccacctgggcctcccaaagtattggaattataatcatgagccaccatacccagctgtcattctgtttattaatctacacgttgtaacaattctttaatcagtaacagacatttaaatttacccccctgtacagtcatttatcctggtccaagaagacatcattaaattcttggcaaatgtcttgcctaaagacaagtggatagtggtctctgtcatccttaatctctccttctaataaaccaaccaataaaatatgtgaggttagttcacagtgtacccattactgtctggttatcactacttctttttccaaatgcttatcgaactcctgtgtaatatttcatcctagaattttccagggattacattacctcatgaatcaatattttccggagcctatttgttttcccactgggatacaagaaccgctttgtgtttgatgccacctctcctgattcctaaacttttcagctattactgtattatttctgtggtcacgtttgaaggcacctatactcacgtaaatgagttctgttttctcctttgcggtttgaagaacattctctttgacagaggaaatgagaaattgactttcagttcatgtgaagccacctgattgagaagtgttcctaactttcctctattttgcttccccccccccccaatccttttcaaaagtcttattttttgtctttagcattccagaaactacacttaaaagttggtgcaaggcttttgtattcaatctcaattatttgctactcctgtcatttgtacattttaacctgaacatagcagttacctctatggccactttggttactttggacacttttcctttcttctccttcctttgttaataactgattaggttatcatggtgagtagccctgagatacacatctgtttctgtccagtgttacgttcattgcccatcccaaagccgcctggcaaccttctgccaatgatctgtcacttaccagcccttcctatttgatcagaatttagttctaagtagccattttccttgctatttctgtgtgtaaatgaaattgctagcagtacaaggcaaaaagttagtgataccctggttttagtagaccaaggttttggagcagctatttagataactaaatcccccacagtactattgcatcttgctagtacttcccctacctgacaaggtggcttatctatatattagtcatttcaagttgtgttcctcagaccagagttccagggaggtatatctcaggtgggaaggaaggaaccagtgcaaaagctctggaatcccgttcctgtttcaacaaagttacactatgttttgtattttgcacattcatcttctgtgtatgcttttttctaagattttattgtgaagattttgaagcatacacataagacgagagaataatatagtgaactaatagaaacccacaacctaaattctgtaatttaaagtaaactgtagaattaagaaagaaaaataaagatctcaaataacctaactttacacttcagaaaactaggaaaagaagaccaaactaagcttcctgttagcagaaggaaggaaataataaagattagaacagaaataaataaaatagagactataaagagaatagaaaagaccaatgaaactaagagttggtgtttttgaaaaggtaaaattgaccaacctttagctagactagccaaaaaaaggactcaaataaaattataaatgaaagatgagacattataactgatactgtagaaatacaaaggatcataagagactactttgagcaattacatgccaacaaattggataacctggaagaaatgaaacatatctggaaatacacagcctaccaaaactgaagtgcaaagaaatagaaaatctgaacagatcaataatgcacaagagattgaatctgtaatcaagaacctcccagaaaaggccaagaccatgtggcttcatgtgtgatttctcccaagtatttaaagaaaaaatattgccaatcctttttaaactctttcaaaaaaagaaaaaaaattgaaggggagggaacacttttaaactcttcttagaaggccagtagaaccttgataccaaaaccagataaggacattacaagaaaactacaggccaatatgcctgatgaatataggtgcaaaaatctgaaacaaaatactacaaaccaaattcaacagcacattaaaaagatcatacaccatgatcaagtggaatgtgttcctgggatgcaaggatggttcgacatatgcaagtcagtaaatgtgatgtaccacataaagagaataaaggataaaaatcatttgattatctcagtggatgtgagaaaaggatggacaaaattcaacatcctctcatgattaaaaacacttcaattagatatagaaggaaggaacttcaataaaggccataaatgaaaaacccacaactaacatgctcaatgatgaaaagccgaaaacttttcctttaagataaggaacaagacaaggaagtcctagccagagcaattaagcaagcaaaagagagaaaaggcatccagatcagaaagaaagatgtaaaattatctctatttatgtacaacatgatcttatatatagaaaaccctaaagacccccccaaaagctattagaattaataaagtcagtaaagttgtaggatacaaagctaacatatacaattcaattacatttttatatacttagactatctacaaaaactgtatcatcaagacaaataaaatgtttaggaataagtttagccaaggaggcgaaagaactgtatactgaaatctgtaagacactcatgaaataaatcgaagaagacacaaataaatggaaagagatcctgtgttcatggagtggaagaactaatattgttaaaatgttcacactacccaaaaaataatctgcagattcaatgtaatccttatcaaaattccaaaggcatttttttcacaaaaattggaaaaacaaccttaaaatgtgtatgtaaccacaaaaaacctgaatagccaaagcaatcccaagaaagaataaagctggaagtgtcacactttgaaatatacatttcaaactatattacaaagctatagtaatcaaaatgtatggtactgacataaaaacacatagaccaatgaaacagaataaagatgccagaaatatatccatatatattatatagtccatctttgacaaggataccaaaaatatacggtaaggagaagacagtctcttcaatgagtggtgtcagggaaactggatatctacattcaaaagaatgaatttggactttatctcacaccatttaaaaaaattaacccaaagtggattaaagacttaaatgtaagacatgaaatcatacaactcctagaagaaaatataaagagctccttgacattggtcttggcagtgatttcttggatgtaacagccaaagcacaagcaaaaacaaaagcaagtgagacaacatcaaactaaaaagctttgcatggcaaatgaaacaatcaacaaaatgaaaaggcagcctatcaaatgggaaaaataattgcaaaccatgtttctgataaagggttaatatacaaaatatataatgaattttacaactcaatagcaataactatgattttaaaacaggcaaatgacttgaatagacatttctccaaagaagacatagaaatggccaacaggtatgtgaaaagatgttcaacatcactttttagggaaatgtaagtcaaaatcacagatatcacctcacacctgttaggatgtctattaaaaaaagaacaagtgttggtgagggtgtaaaggaagggaacccttgtacactgttatgcccaccaacagtgtacaaattggtgcagtcattatggaaaacgatatggaggttcctcaaaaaattaaaaactaatatatgattcagtaatcccacttctgggtatatatccaaaggaagtgaaatcagtatcttgaagagatatctacaccaccatgttcattacagcattatttacaatagccaagatatggaaacaactgaagtatctatcaacaaatgaatggataaggaaattattgtgtatatatacatatacatggtggcgtattattcacataaaaaagaaggaaatcctgtcatttgcaataatgtggatgaaccagaaggacatggtaagtgagatgagccaggcacagaaagacaaatactttgtgatctcacatatacgtggaagctaaaaaagttgaactcacagaagtagagagtagaagggtggtggccaaggactggagagtgggtggaaatggggagatgttggtcaaagggtataaactttttttttttttttttttttttttgagagggagttttgttcttgttgcccaggctggagtgcaatggcacaatctgggctcaccgcaacctctgcctcccgggttcaaccgattctcctgcctcagccccctgagtagctgagattacaggcatgtggcactatgcctggctaattttgtaattttggtagagatggggtttctccatgttgatcaggctggtctcgaactcccaacctcagctgatccatccacctcagcctcccaaagtgctgggattacaggtgtgagccaccacgcctggccaaagagtataaacttttaagataaataagttctggggatctgatgtagagcatggtgactgtatttaattatactgtattactttaaatttgctaacagagtagatcctaagtgtcctcaccaaacgcacacacacacacacacacacacacacacacacacacaatggtaactatgtcatgattaatgcattaattaccttgattgtagtaattatttcacaatgtatgcatatatcagattctgttgtacaccttgaatatataaaatttttgttaattatacctcagtaaagctgggaggaaaaagtaaattttagacatcaagatacttacccctaaatgtttcatcatgcatattactatctagagttcaagatttgcttatggtattttttaagtaaaatttatattcagttgaaatacataaatgttcagtgttccatttgataagctttgacaaaaagctcatgtacctatataaacatctcttatgaagatacatacgccattgccaccccaggctgcttcctcatactccttctgggccagtccccatgccccctccctccctcagctgaaacaactgttccaatgtttttcaccataaattttacctgtttaagaatttcatataaatgaaataggtactgctttttatccagcttctttcactcagagatgtttctgagatttatccatgttgttgcataataatagttcattcattttcatagctgagtagaattccattgtgtggatataacaggttgttcatccatattcctatgatgaacatacttttccagtttttggttatagtaaagctgctatgaacatttttagacaagtctttgtagacatatgctttctttctcttaggtaaatatataggagtggaatttctgagtcatggggaaaaatatatataacattttaagaaactgccagacctttttccaaagttgtatcattttatattcccaccaaaaatgtaagagttccagttgctgatattcgatcttgtcagatgcataaaattcagctgtccaggggagtagatggtgccatccagttgtgttttcagtttacatttctctgatgactaaggatgctgagcactttgtcatctatttactatttggggaagtatctgtacaaatcttctgtccattgttttaaattatcttttcattcttgagttctgtgtatttcttgagttctctatttcttcaatcagattgaagaaataggttcatggcttaaactactagccaaatatgaattattttgataaaatcacttatttttttttaaaaaaattatttattatttttcaagatggagtttttgctcttgttgcccaggctgcagtgcaatggcgtgatctcggctcactgcaacctctgtctcctgggttcaagtgattctcctgcttcagcctcctgaatagctgggatcacaggtgcctgctgccatacctggctaattttttgtatttttagtagagatggggtttcgccgtgttggccagactggtctcgaactcctgacctcaggtgatccacctgccttggcctcccaaagtgctgggattacaggcgtgagccactgcacccagcctcttctttttttttcaacctgatttttctggcacactttccttcccaaatacatgaatctcttgccaatgaatatttccagctgtatagtcacacttgtctaactgctatcactctgttgaacaaagttcattatctgttatgaacttgaatggttgtgtcttcccaaatctgtgttaaagccctaactcccaatgggactgtatttggagataggtcatttagggaagtaactaagattaaatgagtttataagggaggggccctaatctgatagaatcagtgtccttatagaagagatgccagagagctagctttcactctccacacacacaccgcccgctcttcctgtgagcacacagtgagaaggcagctatctacaagccaggaagagagcccgcaccaggaaccaaattggccagcaccttcatcttgcccagcctctaaaactgtgagaaataaatttctgctgtttagctacccagcctagggcattttgttatggcaacccaagcagactaatgtcccatgccattgctatattctcgcattgagttctatgtcatcagtcttggtgatacctgtgagatcttattaccaccacagagctctgtgtccaaaattcaagttccgtttgttggctgctaaaatcacgtcactatcttggctctttttctcattctactttcctatgagtgggcatctcttccgggcatttttctttccatgccagacaagtatctttattaatattcagttttataggttaaagccttcccaattagatcattagtgccctgacagccaccttgtcccaacctccatgagacataccctatcctttatcagagacttaacaggagcacgacccatttttgtagtaccttaaaccatggaccagaaaaccaaattctgttttttgacaccatctgtatggcctgcagattgcttcccatagcctcccttcccttccgaacctagacccttttgctaaatggagaggctaaaataccactgtgtcatttgcatttttaaaaccctccatgccctcaagtccttaagtttcctcctcagaatgtgaaaagctctggaggatgattcttcagagagaaactttgcatggaaaattttatagacagggaaactgaaatgtgaatgtaggggagagtgcacagctttcacgagattctcaggaatttcttccctacaagggattgacaaccactactctggagacatattccagattttttttgttttaagatggagtctcactgttgccaaggctgtagtgcagtggtgtgatcttggctgacagcaacctctgcctcccaggttcaagcaattctcctgcctcagcctcccaagtagcttggattacaggcatccaccaccatgcccagctaatttttgtatttttagtagagtcagggtttcaccatgttggccaggctggtcttgaactcctgacctcaagtgatctgcccgccttggcctcccaaagtgctgggattacaggcatgaaccagtgcacctggccatattccaggtttttctggtgctatcatccattatttcatcacttgatggatagagttgtggtgaagcagcaagttctgatgggtgtaacaagtgcagtttggcttgaagacccagaaaggtcattcatcccaatggctgtgccaggtcttgaggacgtttcctccgtaggccctgccgggaaccactatacatccctgccagtgtctttctcttgagacagcagctggtttcgcagaaccttctagcaactgtcaattccctttattgttgcatggagcagtgattttctttcctattctgagaatcttgaatcacccactgctgcaggaatctctgccttgttatatctcttcagtggccctgaattttttcctctctctttcttcctctatgtcccttttttcccctctgcaacctgaatctcatcccttagagtctgtttccttgaacctttctttttgcattttttcttgccatctagaaaccctgtgtccctcttataagttgagggtgtagagaggcatttctcatgctcttttacttctgtaaagaaacagcttgcatttgtagtgtataaactggatgtgctcctgcttccagctagaagaccagcaggacacatggctgcagctgctgtgactgtcctctgtttccatgctttctggaactcacatgttcaaatgggtttttcttggaaattcttttgttctgcctatttgctagcaaactaatgactctggagggcctcctggaaatcctacctgcctgtttgcttcaggaatctttctaggctcagtactctgctgaggagtgggcagttccgctctgccatcagctagtagttggccaaatacagggcgatcttgactaggagtattacaaagtcacgaaccctcctgcacctgtttcctgctgtatgtctgtgctgttttcagattctctagcatgccagtccaaaaccctctgggagccacttgtaaattacttaataaaattttcatctgggatactggtgactctgtcacaacctcagagagtgcatgtggccttccatattctgtaaggtattccctcggagtcgctgagaggatggaaaaactccatgtctttaaatggctcccgctgcagctgtttttgccaggctgtggctcatgagctgaatatggaagctttttctggtgccagctttgattttgcaccacttgtcaggactgccctggcatgagcagctgactcacattccaccctccacccggggataaaggtggggtggcctgggcacaccactccaaaaagcttttagtcgttactgataaattgggttgtatgtatttggctatgtttgttgaaaaggagctttgctttaaatcaatgtttgcgtgtttgtattaaaaattctttctagcgtctgtggcagaaaccgttgtgttcattttacatcttacttgaggtcccaggtttataagatatcctttgctcttctgccactgcctggactgtagtacaaaagtcactgtaggagatggctgtgaagacacttttgatctcagatgtcagccagactcacagtcaggagtttacactagagacctgtggaggcagcacatttgacatttgagagaaccagaacaagctttttatatgtctatagattcccagaaaataggttctgtagtctaacatttcattcattccctcaaaaatatattgaggacctattgtgagctgggtactgtttgaagaaaaaagagacctagtgcctgcccacatggagcttacattctagttgaaatgtaggaaattgctgttgaactgtttcctttgtatccagtagaaactaacatggataaacgagcccagagaaaggaataacagtggctggggtaataaccaatttcgggctttacagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggtgagccccccacctgccacatgcctcctgcgccgaatgcacctcccaacacctcccttcctgggccactgcaaaccaactggctccccaatctctttctgttgtttgaggctatgacagcgatgttgctagagaaaaggccattgactacaccaccaagatttatgctgtgagcatcagggaaatggaaggcaccaagccacaccagcagctgaaggaagtttccgtggaagaaaggtatggtgttgccaggtttgcttgcttttattatacctgatgacaagaaacttgtttaagccagagtgcgttttctttgccctcaaagttgctgtttaagtcagtcttttataaatcttcacagagtcttcacctgtacacaggcttaagctgagaaaaaattgcacaacatcccagtacgtggcaaagggcggtttatactttgtggaagttggttatggaatgtgacttgaatagacatgaaatttagttggactacacttctccatgcccagaaaaaaatgctagggtagccccaaagcagtcctgactgtggcagctgacaggaaagcctgctgaccagcaaggtaggagggaggacaggattctgaggtcatggaggaatggctgcagagttgtgaaaaaccatcttccattctaaccagaatctgtgccttatactccattcacttggtgtatcttctcttactgtgtcttcatttgcccagatttgtccaggtgggtttggcatttccagcctatcccatttggttttattgccttggatcctctatatagaatgagtgttttctagtattattttggggcttttcaatgtgctgttataagtattgacaagaattgtcaaacactttagcatttctaaaaagaaaagctcagaattactatattacttaatttatcatattcatgctaagagtggatattgaataaaaactcttaataactaaagagaatttcgtggatctcaaagatgttttaataattctgttggctgttcacattgaggtaggctcgatgttgacaatacgctggtcccacaatatgtaatttatgagattcaagtagtttgcatttagtatggctttctgcctaacaacaataagtctgacctatcacttcttactattatgtggggttttagatgcaaagaaatgtaacctcctcctcctcctcctcctcctcctcctcctcctgcttaaattcagtgccagatgttaaaataaacttggtaaatggtgggtgtgctactggcaagaagattgaatctaatgcaaaaaagccctaatttttccctagcatctttgttagatattacaaagatccagagctttcttttaagaaaaaattagagatttttctgcagtggtcttcagagttcattttgcttgcaacatggttttaaagtggccacaaacagaaaataatttttaaaagtcctaattctaagaattaaggggaaaaaagaaccatatgcacagaagtgcatgaataggcctcccacttaaataatccaatctaaaaaaatgtttcacctgaagtattcattcctttggaaaaaaaaaaattacccagcctttctagtttcatttctagtttcacataccattatgaaatgagttgacatggccattatcccaagggtgtttctggctgatttctgtaactcattcgtacatcatgctgagattcatgctagccaccaaaatataatcatttaacccaagctccaaattccaaacactacagctgatttcaaaccctaaccaaggctcacctaatcctcttcttgtctcattgcctctttgggcaaatctgtcaacatttcgtactgccaaacttaatgaaaggtaggaggactgatgatagagaggaccctaagaatttttcattttaaaattcagaattttcatgctaccccattttattatcaagctataccccatcagataggaaactgtatagtcgcatacactggaatgactctttttttttttatcaaaaggaaaaagccttataatattatgaaataggggtaggcagttcagtagtttactggcatttaaaaaaattcacaccaggatttagtgaagaaaacaattttaagataagtatagggtctggaggagtaatcaaaccttttctgtagagagcagcttcctaggtaactttaaaagccttgacagcctcaattcccagaaggagctggaactagagcacacactgccagctgcacagcatgccgggagcagagtggggccctgccaggtagggtcagctagtaaagagcaataaatgatggccaacttagcagtctccatgggggcaaatcacaatcagagccaagaacaagcagactccaccagtcctggtcagtaattttaggggagactgaacctcagagatcagaccgtaggcatcttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccaccatgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgaccgtaggcatcttctggaccacaaaatagaacattgccaggcaaggcagggcatttggggaatttgagagaaagcaggatgagtgatggaattgggagggtggcacaagatgttaaacagcatatcttagtcctcatctagggtataaaacaggacccatggactctagcatcctggaatgacagagggacagagaaggaaaaatggtgacatcaggaccacatgaagccaggcagcagtggccagcttctccctgggaataatcagggccgttgcccagcagctcctgatactgttttctttggcaacttcaagccctgcttgaagatttgagaggcaggggttttccttggtgttcccgtcatcgtgccttccgtatatacctgcagataattctgtatacctgggtgctttttctaaacacttggttcaagacatgcaccaatgagactaatgggagacgagtacttgaggactgaaagagatgtgagcttgggacaaccactccacgcagggtccttagcactgttttgtcacttagcaatgtttcaggcagctctacctctggtaaatcccctgtcacctaaaagcaattagaaaccttgagatgactgtagcacctgtcgtactgagaaaaatgccttgaaggtagctgtgctttatgcatcaattacttttgaagcaactgaattcctaattcctaaattttaagatatttgtggattgtttctaattagactcagttatttgactttaaaatagctgtgagatttcagatcctgcttctttgcacaattgctaattacattgtgagttcttattcttcagaagccatatgatcttcagttctaatctttcagaaaatgaggaagctgagaagaaatttacagttggtctcaaaagaatcctgggctacacctaccagatatgtaatgtccatgaggtgttcagcgggtagcccagttactccagctttcctctaacacactgggataccctgcctccatgacccagactcatctggctggtccccaaccttgggtgatcttgctgctcagctgccacgtgtggtgtgtggctgaggaaagtcatgaagtcttttttacttttgggaatccatgctttcactccttatctgggcactcagggctaccccacgctgccctccttcatccccagccgacttgacgctaattctggtctagaggaacccttccaaaccttcccacctctcaagtgccacgccccaacctgacacacctcttactctcaacttttgaccttatctcctttgccgtgttttcttataatgtactcttttgtccatctacaaacttaagatatttaattgatactttaaatatcagaaaagttccttttgggagaaaaaatgaaggaggaaagcatagtttttcagagcaatttaagatacaaaatgcttatatcatctcaacatgaggtatggtgcccaaatcctgtattcagacttcggtaaaaacagttttccccaattcgtcaagtgatgaaatccctaaggtttgcttggtaccaaattactagagttgcctgttaaattaagaattttcttttcacgttaccaaagtcacacctagcttacatactgttttttgatttataacataggggctttcaagggggtcacccaacccaaactggcctaagcaaaggggaacttactggtttacacacctaagtatgcaggagtggggcaacttcaggtggcacttgttaagagaactcaaatcttgctgccaggattctggttttttccttcatatctcagttcttcttcctctgggttattacagttcttcaggtagaaaaatggctgcagaacttatagtctctgtggttcaaaatcagtaggaaagaactgcctctgattcacaagttccccctacaaatgtcttttgaggtgctattggctctggtgggccccaggactacccttgaaccaatcactatgggctaggaagaaaaagtctttgactcttaccttggaaatagtcacctgccaccatagactagcaatgtaatcacttcacctctctgtaatcacttcccccagaggtgatttggacagacccaaaatagaaaatgtctattacagttcacccttttcttgtcatatatattctcttaaaatggccccatttaaaactattctatatataggccaggcacggtggcttatgcctgtaatcccagaatttgggaagccaaggtgggcagattacatgaggccaggaattcaagaccagcctaggaaacatggtgaaaccctgtctctcctaaaaatacaaaaattagcctggtatggtggcacacgcctgtaatctcagctactcgggaggctgaggcaccaatcgcttgaacccaggaggcagaggttgcagcaagccaagatggcactgctgcactccagcctgggtgacagagtgagactctgcctcaaaaagaaagaaaaaaaaacccactaaaaacccccactatcctatatgtaatttgaaatgcagttatgccaccttcccaaaaagaggcggctcaaagtctcagccagttgccacatccaggatctgagagtactatgaaattttctcatccaggtccagataaagcccctcatggtcctgtggctaatgataatattaaccaccctaacttgccaaatagtggtaaagagaggacagaatgaagataatttttttgaatcaccactttgaaggagggagaatgagacaacacgcagtgatcactggtccatagcgtattgtcttctgctggactgaacaatcaacgattcctgccctagccgtgtgcgagtattatatgactggatggtaatgtgaatgttggaaaataccagcagtcaggatataaaggttttgtttgttctttcaaaacatacacatatggaagtgaaaaataaaagtaggaagtaacataatactctcttaaaagtacagctctccaagtgtcccaggttcctactgggatgtcagtgatgcccctgtattttgtcattctcatgggaaaatttgtatcctcccgccctcccatgagctcctcccttgacgagagactggctcagggcttggctgctccacaggcacgcataagctgtcactttgcttgagggaaggtcaatttttagacatctgccaggagacccacatttcaggtcaatctaaattccgtttttgtcatttagtcctctggcctaagatttggagttatatagtatcaacttagaacatatatacatatatatatatttatatttatatttgagactgggtctggctctgttgcccagagtgtagtatggtggcatgatcctggctcactgcagcctcagcctcctgggctcaagcaattctcccacttcagtcccccaagtacctgggactaggactacaggtgtgcaccaccatacccagcttatctttattttagagatggggtggtcttactgtgtttcccagggtgttctcaaactctttggctcaagcggtcttacaccttggcctcccaagtgctaggattccaggtgtgagccaccatgcccagctcaaaaaatatatttttttacatctcaaactgatacttgaattctcaagggaaagatatatcaattaaacaaattactattttatttcttaagtcaaatcacttgtcactctgccctcatttttggtgataaactgagtatgagttaatttattattggtagatattccttttttaaagtatagtttatattatttgtctctggaaggaatattataaccttttgtaggctcaacaaattttcattaatggtttggtattggcattgcttcgtgtttaggttgtcacgtttggtctttagcagacactcctttggttgggtgtacgtgtcgtttttgtagtaccaccatgtacctttgaaagtgtctgttttttgctaaggagtcccatgcttatctttggtgttcctgtcctgtgaatggcgtctgggctctatgagtacacataagctggagatttggagaacacacaaaatctagttcattctcctttaattgttctttctaatggaaagtggtgattatcacagaaaagaaccttagggtattttactgttgaacagtaattactatcatttgtaactacttttgcgtatgtttttattacctagtattatatctgcataactttttaaaaatcagagatggccagcaaaaattcaaccaaatcaatgtcaagaattattagagacatttaaaactttacccaattaaagtgaaacaattttgatgagtcacagtttttataccaccatctgagcgtgccacaacaatcaacttttaaaatacattcatgctgaggtttgttacttttaaaaattgtagtcttatattcacattatgttttgttattcgcatatatctttaaaaataatgtttaaggccaggcgtagtagctcacacctgtaatctcagcactttggaaggctgaggtgggaggataacttgaatccaggaggttgaggctggcaggagtttagatgagcctgggcaacataaggaggccctatctctacaaacaaaatttaaaaaattagctgggaatgaaaacacactcttataatcccagctactcaggaggctggggtgagaggatcccttgaggccaggagttcaaggctgcagtgagctgtgatcacaccagtgcactccagcctggccaacagagcgagaccctgtccgtgaatgaatgaatcaatgtgtgtttaaacatcttgggctcatctccagaggttttcattatcacattaagagaaagccagaaattagaaacttataactacggaaatatttagtgccaatgtctacattttttgttcttatcaaattatcatgtggcttcagttttgtatactgtggtaactacacgatcacaaaggaacattctttttgataattgatatgtagcatctaataatatctctaagtgtgggttatgatcttttactgaaattcatatgagctgaccaggtattagtcttcctagttacatctggtggagccatggttagtaatttatttttaaatgcctcctgtttgacataggtggatgtcctcatttcttcctcacttaaccggccacataggggttggtcataatggatatttttatttgctatatacagttggaacctgcattctacagaaacccaactttataataagatacagaataaatggagaattaaactattacagaaattggcatataagtactcacttaacctttatgttttgaagaggatacaataattagctcaaggattgttttctcaatgcacctgagtcagccatctgtatttttttcaaggtcctttattaacaactgctgaggcatacagcttttgactgtctatccagggatgaataaatgaatgttagacttaccacttcctgtttctacattatttttataacattattttacttatagcatttttcacctgtcactgaaaagaggtttaactgctccttcttttcttacctgagaagctgcataacttatggccaaaagtcaaaattccaaactcacctaaagcatatttttttccttccgcagtagactttgggcttgttgccagtctctcctgcttagctcaggctaaaacggtcatgtctctctttttttttttttttttttttaaagtctgggccgggcacagtggctcacgcctgtaatcccagcactgtgggaggcggaggagggtggatcaccagaggtcaggagttcgagacgtgcctgaccaacgtggaaaaaccccatctctactaaacatataaaattagctggctgtggtgcacatgcctgtaatcccagctacttgagaggctgaggcaggagaattgcttaaacccgggaggtggaggttgtggtgagccgagatcaagccattgcactccagcctgggcaacaagagcgaaactctgtctcaaaaaaaaaaaagaagaagtcttaggctaagcatggtggggcaagccggttatcccagcactttgggaagccgaggcaggaggatggcttgagagcagcctggacaatatagggagaccttgtctctaccaaaaatttaaaagcctgatgtggtggtttagttgcttgggaggctgagataaaaggatcacttgagcctgggaggtcaaggctgcagtgagccatgatcatgccactgtactccagcctgggccatagagcaagactctgtctttaaaaaaaaaaaaaaaaaaaaaaaaaaaaagtagaaaagttagtttttaatgcttaaattatattgccttagctccaacttagtgtagtttactttataaattatggataactgtagatactgtgatatttatagttttagtcactgatttgttagattttatccagttattcagctgttttacctgggtagatgacatgtacacagccatcttctaaaaaaagtttcaagcaacagtgtttttatatactctatcaatcaaactttgtgcattaattaaatactgtttgtatttaaatcattatggaatctctgacttctacaagagttgggtcaatgagaatcaaagcaaaacttggctccccttggatttcctcttacgtataaaacctctttatacgtaaagaggtttgctttaatcccacttctgacaccaatctgcttcgtcctcacaggacagtgatgttagtgatgtgaatgatggaaaagtgattgtataaaagttaggtggggccaggtgctgtggctcacgcctgtaatcctagcacattgggaggccgaggcgggcagatcacctgaggtcaggagttcgagaccagcctggccaacatggcaaaactttgtctctactaaaaatacaaaaattagctaggcatggtggcgggcacctgtaatcacagctactcgggaggctgagggaggagaattacttgaatcactccagcctgggcaacaagagcaaaactccatctcaaaaaaaagttagatgaagtttctgtaattttagggtatgcagaaagctatagatacagttacataaggcaggagctaatagcaatttttaggcggcactgttagggcttcccaagtccctctcatgcctcagtgagacatacagccatgcttattggcatttttccaagcacaagaggcttcctttatttctctgagatgtattttatacttttctaccatctcctcctgaaacacatacccaaatgtttagcagaatctgagtacatgcctaccagctcccacagtataagtaactactacaaaacagttctaacatactttgacacgtccactatgggaactaactgactttggcttcaacagaaccctgcctcaggcccaggcttcacgctgtctgaggttctcttcagcacaatgtgatgggttccttggacatcttctggctgcacctgttcggatctctgagaagattttgtttgtctttgttctgttttgccaagtctgagattggcactggggaaaattgcctttctgagggctttatttttggtttccgtattatctcatttctgttggtgggagacctgggagttgccttaagaactgaacaatcacaggcccttgctgttgacctgatcagggttacacgtaaagctctcctctcccaagtaggttgtcaactctgtgaaagcaaaatttctgttttatacactgctttatctctataatctagaacatgctggcacttagtaaatgtgtgttgaatgaataaatggattccttaacaacaagatttagattcattttcattctagcccatggattagatatcaaattctgagatcttgttgacactttgtcattaaaatccataatccagctaggaaatctctgcttctaagcagttggcctccctggtcatccttccagcgctcaggctgcagcattctccatctggcttctgcctttaggcaattccaagtagtggtctgaagtggagaagcccttgccccagactgcatctcagtggtgttgagggtagttgtctgctttgtctggcagggaatgtgtgatagtggatgtttaggaggggtctagaggatcaggcaactctcctttctctgtcatacttgctgtaagtttacttccatgtggatggatgagtactgcttccaacagtccccatggacgaggactcatttccaagtaccagtagccccttgtgatatgcacccatatttggctgatcgcagctgtcagcattccatcattttcaatagcccccacttgtggaccagcaggcatgtcataatcctgaagggtgatccttatcctccccgctccctgcagtgcccctgcctgggttctgctctgtctctcttgaccctccctccaggcaacagcagaggctaacaactttcatacaagagatggttgtcctggtttaatgagatttgggcatcccatacaagtctaggggtgtgtcccaagtggaattcctctcccaattctctgtgaagagaggggaaaggaaccatttcacttcacaaactgccttccactatagaggcaacttaactctccagccatctcagcggcccggcacaagcaaacacgaggaggcggtgccagaattattcttagcagcagattataaaggaggaatctgtgaatattctgcattaatattttagtccttgtggaatatattcactgtcaatctatggcatatgttccttaggaaaccaaggaacttttaccaaaccaaaattagaagtagtttctaagccttttataaatggtggtgcccttacctgtgaactgacaggcgctagcaccaaatgacctcaaaattccactgtagtattagcattttccagaatttttattagactgtgcttacagttgaatggataaggcattaaaacctatcttccacctcattctttctgagttgatttgaatgggtttatgaactgaaacaaaaagaaagttctataaagaaaactatatactgtgggcttaaaaaaattttatggggtttcagagattttttttgtttgttttggtcatgttttggtttcaactctaaattaatagccttctttaatccttgattccttaatttattagtctgtggcgtcaatataaaatttcactggattataaactgtgtaggattatcagttccccagtggctggtactgtacctatcatgggaccactgtgtgtctaacgtggtaccttacacttaatacacagcaaacaaatacttttcaaatgaatagatgaatggaccaatttacttagcctgattctcttaatatttaatctgtcttcaagatgctgtgcaagtccattcttggtcagcgaccacttttaccttcacttcattagcaactatggatggtctttgtgggaaatgatgtgactgatgtagaatccagggtgccccagttggccctgggactgcacttggcaaaatgactttttgatctttgtagtatctgtccttcaggaattacaatgtttgtttggtttaaatctgtttaaccccaggcaaaaggaatcaagaagattctgtgtcactgtggctatcatgcctattgtacacaccaaggtgctttgtcagcaggtttacaatgaaacaaagaacatgctcataagtgactacgagaaaacgggaaggatgtagacaggtttccttcagtcaccaaatcaccgtatataagtaatcccagttttccttctaaccttttatgctgtgcttggaaacagaaatctgggagaagttgcccccagtttgtatttagtttctaattttttaattgacatgcaataattttatatgtttataaggtacatagtttcaatattttcaatgtatagtggtcaaattggtatcattagcatatctttcacctcgaacatttgtcatttatttctgttgggaccattcaaaatcctctcttctgctgttcactcatatgtggaagctgcccccagttttttttaaacgccttatttaatcaggagatctgtgggaatttcaagctcgcctgaggcatgatgagcatggtgaagtggcacagtgtcaacggcaaatgagcaacctgtgctcccagctccttcctcagcgtagccggacagaggccctttgttgtcattgatcaatagctgttttgtgggcctgtattgttagagttgctaagaactgaccatcctgctaagctaatgctgctggatttaccatatagagattgatgaaaactgctcaatcctatcttgaagcttggcccaataaatggggaggaacttctagttctacatttccatcccgtttccaaggctggagtgagcttacagagcctgagagttggtacagagatctgcagttgcatgtgtgttgtttaagctgagcccagctctccccatgggagagtgatggcacacgcgtagtgcacgcagggcgaggagcactcctgctccagagcccttctctcgaagctgcgttcttcttcatcccaccccttcgttctgcaagagttctgcccgcatagctgcagcgagcaggtagaaatgcaagactcctgttctttatgaagttggaagggactgaaattataatatctattaaacccagaaatgctgaaattaatcatctccaaggcctattgcttagttaggtaactccactaaaagctgaatcattcgttgatttttttctaagtgaatatgatgctattttcataaatgattttctttattcaaaccccttgattttctgtattggtttgaagcaaagcaatgacttctgtctgataattttaggcattaaacctgctgttcattatagaatagtttcttcacttttgatgacaaagagtggccagtgtataaaaatccagaagtaaagtgttggaaaatgatttttagaagcttaatgtgcctaggaaatcacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggttacatcatcaccaggaactcctttgtccctcagtgtcttaaccagctgtcctctggatttctcattcccgggtacacctgatcttcatcaagacaaataagtgcctagacaccttcatttttccccaagttcatcagcccttcctggcctcactttttgtgcctacccaaatgccatttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaacaggtcctttgattaatcttataaacttacacatttctgccgtcaccttccttccaacctttttcctttctcattcaggccttgtagtcttttcttcattctctatcctatctcatctgtcctctgtccctgccattctgctgacatgggggctctttaacccctgagtccagtgactctcctctctctgtcttactaagagaacttgtttcttctagagtagcattgtccagtagaaatatgtgagccacgtgtataaattttctagcaggcacattaaaaaagttgagatggtgacattgattttaacaatatattttaactcgatatattaaaaaatatttcaacatgtaatataaaattatattttacattctgttaaaaacttttcagtaggacttcaaattccagtgtgtattttatagttatagcacaattcaaacttttgaaagccacatgtggcattggctactgaattggacagtgcgtgttagagaagaatataaacgttcttctctcgcctttttgaaagaatctctcttggcccttctggtgcctccctctctcttctcagtgtctcacctctgcttcctcttccagccccttacatgctgttggtcctcaggattttacctttggctggcatcttttcaccctctaccatctaccctctctcttaattaatcttttatatcccacccattggctagtgattcccagggtcatgtcactgactcccatctctcagtggaacttccaactaacaaagctatctcacgggtgttcaaagctcaacgtgccaaaattgaactcatcatcttccctcattgatattttctctctgtctcattccatgatacaaccatctgtccagatatgcaagctggaaaactggtattgcccttgagttgcttttcctacttcatcccctaaagactctccatgacaaagtgctgtgaagtctatttcgccaacctttctttaaatattcacctgttttcttctccataaccactgctccagtcaagtgcttcatcattcctctcttggatcatcacagtggcctcttcagtattctgcccatctttacttagttccctttacgccaccctttgtactctcattttttcacccaaataactttgtattcacctaaaatagccaagtctaagacgatatccccattttttaaaacaacaacaaaaagacacaaagctgtgtgataggcttcagtcaagagcattttcaagagggtaggcttctttcaggacatcctgcagttcttctgcctgaatcctttccatcaccccatcactaagtatctctgtacatgattctggaagacataggaatacactcaacagagtccagttcttaggaatactgttaacagagtccagttctgaagaatgcacttgacacagtccagtttggtcttgataacagagaggccccctggctttggagatttttcctaaccctggatttatcctagagcagtggttgctaatttctctgtgtttctcgcccctccctttctccctcccctcccccatccattcctccctacccccctccttccctcctccttcactccttccctcctccctctctgcctcccccttctcccattcctccctctctccctcctctcccactcctccctctctcctcccatcccattcctccctccctcatccctccctacccctcctccccctcccctctttccccctcccctctctcccctcccccttctctctcccttctctctctccctcccccttctctctcccctctctctctccctcccccttctctctcccctctctctctgcctcccccttctctctcccctccccctcccctttggatttcccaagacattctaaaaccattggagcattttatgccacattttggaagctgaagaaagctgtttcctccaaggacactttgaacattgtctgatgaacacgactcaaaacaacttcaaacttgaatttcttggctagttggaactgagtttccccacactcacacccacacccacacccctctttatagaaactggttggaacgacttggtttctcacaggctgtccaagcctcactccccagttggctctcatgttgtactcatcttgggttgcaactgactcgtgacctcagtggtttcagaagcttccctgagcactttggccctgaatgctcttacacatttcaggtcattgtgtgctctgctccacctcttgctctgtcagcccagtgccttggggagggggaaaggagggacaagtacccaggcattggcctgccttgcgggtctgtgcagggcaagagcccgtgtcaggataagactccccacatctttagttgagtctaagctttctcttcagcagcccagcgctgggcagtgggatgacagcaggaattggccttcccatgatcctgccctgcccacagaatgtgccaactgtttccacagggggtacagggttgtgactctccccacaggcactgaagagcagggccgacttgttactcaacaccaagccccaggctggagttcacagcctctccctgggcttcctgccttcactctgtcttcttggcaggcttctcctgctctccagagcttcggcctgtgtgccaccctctctcctgattatccagtttgtttgctgtcttgccaggctccctccttaaatttcttgccaatggaagctctttctcctttgttccctgaccctgcccccctgcccattctcctcaaagcctacttgccccaccaggcccctttgtgtctctgctcctcccacctccagtctctcaccccctcaccttcccagatcttggccccactgggtctccctgccaatgccgggttgtgcccacagccttcctcgcactcctgtcctgtgccagctgggaatgaccaactctaatgagctgattggactgaaagtgagtgaatgtcctcatgcctccactccttcccacctcagcaaagcttttcagagtcccatttctgatggaatctgaatctagaaggatttagatccacggaaaactgttaaacctccagtgtttggctacgtgtgaagtctctggcagtccctcccacatctgatgttatgaacactgtttatagatgcctggaaagaagcttttaatacttgtattgtgttttaacttgctttcctttggaggcagggaattgtcaagtaagtattcacaccgctctggagacaaacacaggtgtttggtgaacatccagtactaagtgttcacgcagaatccacaaccgcgaagggtcaatacttaaaatccgctgaatttgccacaatgcaggtttcttccccttgctcctctcatcttcagttttgaagcaatacagctgtaaacatatgcttgcgaaatgagaaagaaacattgagattgctttacctttcggtttttttctgaaaatcaaggtgaaaaaaaaaagcatcggattgcgtctgtgtatatatatacaatctcctgtatatataaatacacggtgtttgtgcttgtacgcatactctatattcactgtataatatattacatattatacaacctgtgtgtcccctgaaatcgagccctgtgtttatcctcaaataatgccttatgagccatgccatagttccagtgtcctcttgctctcctcatagcccctggcttgcttttgtcatacacttaaacgttcttaggtgaaagaagaaacccacggatttcatttgaaagtcccactaaaacagaagaaagagcagatgtcctgggaagcgataattaatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcaggctgacctaccaagaaacactgggaattattaggctaaattatgagttgaacttgatttggaaacaaagtatccattgtacataactccccacgacatccaggaagatgtcattgtttttctgacagcaagtttctccccagcacactctaagcagagtccccgggcgcattcgtaaagtcacggagagtgtgcgggaagcattgacaaagcttccttttctctccctattctgtaggcgctttagtgcagagtttgcccagagacgccagggtatgagctttctgaatttgtagactggtgcactctttcatttctgttttagttctttgctggcatgctggggaagcatggtgtgtgccacacaggaatgtctgttcacttggaaaatgcttgtgcatgaatgaggtggttgctaatgcggctctaaactgtactaagtttctcacttggctttgtttgctgctttcaaggggatcaaggtaatccttctctttgcatatcccgggagcaataactaattactttggaacatgcggtgggagctggtacagttctttctcgacccatccatagagaaatctgatttaaggaaaccccacgtcaccaagaactggcgtactcctctaggattccattagggcttacacattataaaatctcttcattaaatttggaggccccagaccccaaaacggaggcgggaaaagcaacctttggtgtggtagcagctgaatgcagacccgagtcctgaggcgagggcggagtgggaggcgggagtgctgtctgtctcctgtccctctgcttcctgcctgcctgtctgagaagtgaggccgacctaggcacttggcctgtggtccttagggccctttccgcagcctggcttgtaagtgccacttcacgccacaccatggccatcgacaacttaattctgaacaacatgagcacatccctgtctgaaaaaggtcagcaagtccaggaaatgtggcctcccgcccctcatggtcaggcttctccttggttttgaaccaagcccctcttgtttcaagcccacatgttcttcctgctccccctgctcccaggagaaggttaagcagagggaggagggctgaccctgaccacggtgcctcaagcgtggggaggcccaacccagtgcctgtgaattcaggctgggtcccgtggcaggcggggagtgagagaggagggcaggactgaacagatccaagtggaggggcctttgaggcgggaggagagaggaggccggcactggcctagacaggccacaccgggaaggcagccttgcagcccttgttcaatgctgtgcttcctctggccgctctctcttccagaccacccgttagccgagcagctccccagcctgagaaactgcagaagaacaatatcaccaaaaaaaagaaactggttgaggtgagttaaacaatcacttgtagtctgatattgacgttctaagacatacctggtagacatccccatctgcacgtcccaaagacacagtcaaatgaaacggagtaggtcccttgggctctcttttgtcccctctccctcctacgtagcactgtgtcttccatcccagggaccagagtcgcagccactgtatcgtattcctgcttcccccagccctgtcaccaggtcctttcagtactaaatctaagatgtcctgtgtccctcaagcctggctccgtttccctccacttggtcccactcagaccctcagcatcccttccatggagaagaaaggaaagagacaggggagcacatattcaccgtctctaatgttgcctgagccccgactgtttgccgggtgccctgctccatagccacgaagcgtttcatacaatcttcacacacaggagggacgcaccattactgtttccattttcccgacgaggacgctgtggctgaggggagttgagggagttatcaggtcccaagcccaagatcaccaagccagtaagtggaaagggatttgaactcaattgttgagactaggctctcataaagtcagaggcctcctgactgttctgcctgacttcagactccaccctctctctctgacacatgccccaatgcctccagagttggttttttaaagtatacatcttccatgcctcatgctggccttcagacctgggagagtcccacattgccaatgggattcaagttcatggtttcaaaaccttacccagagccaccttctaagcttaccgcctatgatttttcaccacagtgcaaatctctggccccccaaacccaccgctagtgttctcggaagctgcctgggactttcaagcccctgtgttgtcattccttctgcttagaaggctcctcctgccagctcccagtaccctggtctttccaagaccttctccagtatcttttctgtagagtctttcctgatgcttctcaccctaaaccttcctgcagttccctgcccacaccccatccttccacctgcacagtgataggcacagaggagctgcctgagaggtctgtgttggattaagaactgatctgaatcagccactgttctttgtcttagaagacaagacaggaagatgagaaagactataaacctcaacagtatctagtttttgggggaaaaaaatggcaaatatgtagcaactttgtagagcaagcaccaggcagcagaacgagcatggcctttgactctatgttctgctctacccaccctggtcacattgatgagagtttattagagcaaacctctgagccaccattcagctcacccagagtgcctgccaaggcacagacacaaaactgctaggtaccctttacagggcatcaaatctctggactttggcacactgacagagccaggaagtaaatctgggttttttggaaagtcatggtgattctgtgtgttagactgccaccccagcatttcagaaaactaaagaaggggctgcattttctcctcagccagtcaagaagcaaaatgttttcagtgagtgtgtgttggcgtcaccagccataccgttcctgggacacacgaggctgctcacgcaatgtgggtgtgttcctcggctctcccttccttcctctgagggtcacattgatctgtgtgtgtgaatgcaggagctggctctagaccacgtgtttggctacagaggtttcgactgtcgaaataacctgcattaccttaatgatggcgctgacatcatcttccacacagcagcggctggcatcgttcagaacctctccacaggtaaccgggggttaaaaaatacaggtttttcttttagctgttttttacatgctttccccactctttagatgcccaaaagcttaagcattttccttcccttatagagccattccccccaattccagcatggtctcagttaggcctggtaacgctcaggttcagttaccagagtcagagccttctctctttctgacctgagcttgacctcacctcatcataggccctagagagaaggcggccatgttgacaccagcctctgtaaccgacagccatggagaaaagcaagagacagggtgtaaggagtggagaaattccttggagaccataaccatgaagaaatcacagaactttgcctattcatttttacaatgagctattttttaacagctcagatttttcaagttgtattttgacagtttagccacatttataatgagaatgaaaacaattaaacaataaacaaaaataccaggcccggcaaggtggctcatgcctgtaatcccagcactttgagaggctgaggtgggcggatcacctgaggtcaggagttcgagaccagcccggtcaacatagagaaaccccatctctactaaaaatacaaaaattagccaggcatggtggcaggtgcctgtagtcccagctactcaggaagctgaggcaggagaacccagtttgaggttgcttgaacctgggaggtggaggttgcagtgagccaagatcgcgccattgcactccagcctgagcaacagagggagactcttatttcaaaaagaaaaaaaaaaatactcaaaccacatggtgactcaaattttaaaaatgaacatttcaaacaaaaagaaccattcagaaattaacagaaaactatatcattaccaccagatttaaacaggttcacattttgccttatttgctcatgcctcaagaaaaaaaaaaaaacacctttcattttaaatttttgttctttgtcaattctgtgtagttgttcatacatagatttaaacagtgaaatcactgggcacatgttgatttgtgtgtatctgagggggaggaggaccttgacattgtctatatattttcttcactttctagccttgccatcatattggtagcagtacacaccttccttgtgtatctacaccatcattcatctttaggttcttgagcatttgggtgggtttaaagtggctattatggaagtcagcaaacccatttgctttgatagatggtaaagtgctctttcttccacttcctgtgacatatgtcgagttagggctttccagggtaaagccatcacctgtgctgtccaggcccccaagtggattggcatttggtgagcaaaggtgattagtccctgagaatttcatattccacatgaagaagtggtaccattttgctcagtaaagcatcatctccaggcctccacccctacttctgcccagatgtggacactgagaagcaccagtcctgtgccatggagtggaggagactttgaccttcatcattgtggactctggaaacccctgtacttgaactgtgctctggacccacacagagttgtgggaagtatcgaagagcagcttgagtgtatcagataacagacagtagctccccttctcccagacccaaaacagaatatgaacattccaaaaaaacgacccttcatctccccaagtgtgattctggaagtgagaatttgagggctgtaagctctcacttttataagaagtatccaatggctccacgcgatgttttgaagttgccctaaaaggtctttaggttccactgttcaccctcccatgatctctctcccccagggagccagagcttctatctggagcacacagatgacatcctctgtctcacagtgaaccagcaccccaagtacagaaacgtggtggccaccagccagataggtaggaggtcctgtggcagctgaggctctcccagcttgcagggacgctgacctgtcagcaattattgggagagggagtgggtgggttgcttacatccatcccttcttgttgatgttgctgttgattttttgagtcctgagtgtatctgtgtcacctgcgttgacacatccagtgactgtgattctgagggaccataaagtctgaccagcgcctgagagtccaaataaacgttggcccccatccctgtggacttgtaagaatagtttttcagaccccaagtgtcaagaactccgtgtcttttgaagctggttattgtgcttggccagggtaggtttcagtaagtgtgcctggaccccctgtgccctgggaaactgccggtgacaaatgtgaactgattcacatttatgagaagtttgttttcacttagtcatctcgagcaatttttacaacttcctgcttgttttcattgaatcatgtccatttttaagtttaatttggaactttctgatgctggtgttgagtgcttcactgttggaaacgtgacttattttagctattgttttcccttgacgcttcctcattgccattgctcacccaatgcaggtgatattacggaaaccccaggtaaggctgttccatccgtgagtagtttgaatctgcagagcaaaatcatgtcattctatcatgtttgctgattgtatcttgccgaattgcagatacaaatcattgacctcaccagtttccttcgtataaaatcctctgcaagtgtgtgtgtgttgaacataaatgtccgtagggctctgcctttaaaagcaaatttcctctagtctttctcctctggccaggtcaggctataggtctcttatgcccaatgactgtaacagccctaaacatttgtcttaaaaaaggcttttgcaggccgggcggcagtggctcacatttgtaatcccagcactttgggaggcgggcggatcacctgaggtcaggagtttgagaccagcctggccaacatggtgaaatgctgtctctgctgaaaatacaaaaattagctgggtgtggtggtgcgtgcctgtaatcccagctactcgggaggctgaggcacgaggatcgtgtgaacccaggacgtggaggttgcggtgagctgagctggtgccactgcactctggcctgggcaacagagcaagactctgtctaaaaaaaaaaaaaaaaaggcttttacatgaacataagcatcgccttggctctgccatttgtcagccttacttctttgtcatgcctctccacactcagggacaacaccttccatccacatatgggacgccatgaccaaacacaccctctccatgctgcggtgcttccactccaagggggtgaattacatcaacttcagtgcaactggaaagctcctggtgtcggtgggagtggaccctgagcacaccatcactgtctggcgatggcaggaaggtaaaccagcactgggctttctgtccctccagggtgtctgcctgtgggtgtcgagcctgtgggctcgaacccagatctgcctcactccgaagcctgccgtaggcactgactgctgctgggcaagtggaaaacagggcactggggatcctggtatagctgccccactgatgccagtgcatcccagggtcccagggccaggaggaggctggccagggactccagggcccattagtgaaggggctctgaggaggttccccgatgttggcagccctcctcctcggaaggcagcagcctccccgacatctgtcttagccaccttcctacccaagggtccttgtcttccgtgctctttctgatggcccctggatcctactacagccctatcactttgtctgctttattttaggaaatgggatcatgttttatcatagtctcagaaacatttaaattttttttttaacattttaacacttttgaaatagggatttatcttacaatccaggtttacatttactgtaacaggatttctttctagtcctcccccaatacatgcacacacacctcacacacatgcacacacacaagctgcaactgaatgtgtggtcatcttagaactaaagatgtgcagtcctcctcatatattctcaggttgggtactgccctggcaagagcagatccaattagtcagaacattaatgaggtctgtctgcagctaggcagcctgtatctgggacacgctctaccaggcaagcgcagaggtgtcacttctcccatccagggctctggagtcccattatctctgcatcttcccatggagggggtggtgcgtggaggttgtaaagagatcagcacactgggggaaagttccagtcactcctgagcacccccatatgaggaaaagagcctgacagcttgcagacatttgtaatgataccatattccttcagaaggtgacatgatctataatgtttctaggaaaccacatgttctcattctctggttcaccagtatatctcacccagatggctgcacagtcagtatcccaggggtgcagattcattccttgtgatgtcaagtggccaactgattgaccagactcagcccagagaaattgagcatcttaaatgatagacagagagcatcttggagtgggaagaactagagaagacttcctgcagttaggacccatcctaaggagaaattccttcaaatgcacccctttgtcctttcaaggggtgtggctttcaaggaccccttgaatactttcaaggatgtggctctcctcacttcacaaggcagcccacacgctgtcagaaagctcttgcgtaaagccccttcttatgtggggacagaaattgcttcattatatgtttcttctgtgctgctaactgttcctagatccttggaagaaagctctcacactggccccactgcacggccttgtctttttaggttcaggctcactgtcttcactccctctacctgtcctccaagcagtgcctgctttggcctgccctagcacagactcttgctcacccagggtcccttctgacctcccaggggaaggttagaggagccagggcttttaaacaagctcccgaggaaaagaggagcctgctcttgtttgtacagagggttgtgagccagtgctgatatgtgacctatcgctagccaccacctcttccgggttgaccacggacatgtcatttctcctcccttccttctccagtgtgggtttgccttcatttcaagtcttacttacagataaatagcatgtgtttggggaggtttacatacattttatgtatcactagagagcctattattcattcttcatttattagaggattgttttggggaacgtgtgtgtgtgtgtgtgtaggtaaaaataaaatagacctaaaaatgagcttattacataaaatccatgtcgtcaggtcctaggtatatgtgtaatttgctctgagcagactagaagccaatgcagagagggatacaggtgtctccacaattagaagcgtccatgaaattaaaacaaggaaaatataaacagtggctttgaaaaaatgtgcaactcattgtttgtttgcacttctcccatgactggtgagctggaatctctttcctttgtttgcacttctcccatgactggtgagctggaatctctttccatctcattggccacttgtattggctgcttttgtaatctacctgttcaaatccttttactacttggagtgggagggttgtcttttacttataatttgtagttccttatagatctctaatgttaatcctctgaatcttataagcattgcaagtgctttcttcccgtatgttgtgttactttgtttatggtatccttggagactgtgggtcttaaaacctctgagccctaagtagagagagatctgctacagtaagtcagagattccatatgcagagagaattacagctgggagaagttctctgtgggtccccctagcctcgcctggaaagagattctgttagggagtatcagaggggtggccacaggcccagctacatcaaaacccaccaccatcatggtactagaaagctgtcataaaaacaaatgcgaagtgatgagaacgaagaagaaaaaaataggtgtgtgaataatcaagggaggggtgacaagaaatcggaacaaaaacattcagagtaagttaaagggtaacaggtttaaaacaaaaatttaaaactcgagagcttaaaaataatgagattaaaaaagaggtgagtttaaaatacaggctaaaagaatagaagccaagaaattttaaaagtagctaaaggagtgatgataatactattactactactactaatactggctaacacatgatcactcagagtatcaagcactgtgctcagggcttcacttacttcaattctttttatctgcactgcaccttctgaaataggaacaattattagccccatcttacaggtaaggaaactaaagcacagagagcttaaataatttgtctaaagttgttctacaagtaaatggtagagttggaattttattaagacaaaggttaaataaaactcaggagacataaataaatggggttaaggaaaaatagtacttaaaaggtaaaaaaatttaaacctaaacaccacaaactaaaaaggaaaacggggaacttaaagaaaatgcaggagaatcttaggaaaaaaaaaaaaaaaaaagctctctagaggaatgtgagtcccagtggccctctgggagcggctctgtcatcctgtggggggacgactcctgtggtgatgctggggacttgatggaagggggatgggggatatctttaagccactttgctgccttctcatatctggaagcttccatctcacaggccatcctttcttgctacgttcatgaatgcctgggttgggggatctgttaccagcacctgctgctctggaaacttgccagacacactttccccgctgccacctggggaatagtgtctgaaggggagagagtgctgtaaagaagaactgaggcatggcttacgcctgctggggtggagacctcctgggctgcggctcccccggcctggcccatgaagcaatgaggagcctcactggactctgtcacccacacaggtgccaaggttgccagccgagggggtcacctggagcgcatatttgtggtggaatttcgccccgactcagacacgcagtttgtatctgtcggggtcaaacatatgaagttctggaccctggcaggcagcgccttgctttacaagaaaggggtcatcgggtccctgggagctgccaaaatgcagacgatgctctccgtggccttcggtgctgtgagttctagcagatactccctgagaaggggacccagaccccctgggcatgggcatgggcatgggcaggaggggagtttggccaagaggctgaaaacagcaggaaagccatttccacattcgctcctgtactggcttatctgcaaccactgttccttttctgtagcacatatgggtgggttggcaacatacatatatatattatttttctgagacagagtcttgctctgtcacctaggctggagtgcagtggcgcaatctcggctcactgcaacctccacctcccaggctcaagcgattctcctgcctcagcctcccaagtagctgggactataggcacctgccaccacgcctggctaatttttgtatttttagtagaaacagggtttcaccatgttgaccaggctggtcttgaactcctgacctcaggtgatccgcctgcctcagcctcccaaagtactaggattacaggtgtgagccacctcgcctggccaatattttttttttcttaaaatattaaccagaaaaggtaggacacccacccaggacaggaggtttgttgttctaaaggcaaccctgagttgcaagccccagaggatattgggaacaatttccactgtagataatgatcctttttcttaccagccctcttgtgccacagatgcccccaattaccacccttaagtgggctatggggtgccctcagccaatgcaagctccaacttcgtggtcctccaggagtgggtttctccctcttgtagaggagccctaggaaagtgtcctttggcctggagtctgccccatccctgctgtcacttgggccatgcttacagaagggaagtccttgctaatgcacagctgtgctcagaggggaagtcagatgcccaagccagttaaatatagtgaatttccaagccaggtgactgccttgtgatgtgctctcggtgatttctttgcaaattctgctgctttccttagcacaaagagatcaaactgcctaggctgtctgcatctctagctctggttccttaatgagagaacgggtggctggggagggacccgcttgagtgtgttccgggtgtagaagatgttgttttgtttacagaacaatctcactttcacgggtgccatcaatggagatgtctacgtctggaaggaccacttcctcatccggctggtggccaaggctcacacaggccccgtgttcacaatgtacacaacccttcgggatggactcatagtgaccggcggaaaagagaggccgtaagccaaagctcctatggaaacaacttgtcgtttgttgttatcttgggagaaactgacaaaagtgttcccaacttggagaaaatgcagactgtcatcctcctatcttttttgcattaggaagatcagtctgctctctctccaagagggccctaagtcaagatcctcacaaggaagagaggagtgcagaggtggtttgatgatagtttaaaaacctgagagaggcatggtggttcacgcctgtaatctcagcactttgggaggccaaggtgggcagatcacctgaggtcaggagttcaaaaccagcctggtcaacatggtgaaaccctgactctactgaaaatacaaaatttggccgggcatggtggtgggcgcctgtaataccaactactagggaggctgaggcaggagaatggctggaacccaggaagcggaggttgcagtgagccgagatcatgtcattgcactccagcctgggcgacaagagtgaaactccatctcaaaataaattaataaattaaaagaaaatcttgagaggtattcttgaacaaaccacagtgactttgctgttgataaaacgttattcttagtagctctgtggaggaatggaggaaggaggagaagaggggagatgcagaagcaaagcctgaagacaggagaaacatttctgtgttctaatctaataaaaagtctgaatttccaaattacgttttctttcctcccaagatagtagcatttgaaggcattttaggaaatctgcaagctcaggaggttgggattgcttagcaccagggcctaagagagaggctgcctggagggtctggaccctggagggtctttccttctgggccccaactggccagaaccctgatgactgggaaagaggggagagggccggaggggtagtgggtcttaggatgagggttaacagcctgagtccctttcaatcttttttaggaccaaagaaggaggtgctgtaaaattgtgggaccaggagatgaagcgctgccgggcctttcagctggagaccgggcagctggtggagtgtgtgcgctccgtgtgccgtggaaaagtgagcacagccagctcccctgggggctgggccagggaagggggaagtgtaggtaccctcccagccggcactttctctgggctggtttgtttactccttgaaacaaggcctcaatacatgaattgtgctgtagtgggaagcagcttaagagagtcagactcccccaggaagaaccagctgggtgaccttgggtgtgttccttaatgtttttgtgtccagcacacaggtttgtcatgaggtttttgtgagggtcacatatttatacatgacagtgcctttcatcttacctggcatatagtcccattcaggagatgttagctactagtattatagatgatatcctcataagctcagagatactaaatagtttgcccatgccctaagctatagggccagtaaggaggagggtaagggccaccaaactgtctgactcaaagccattggtttccaactcatatttgggtagcgtatcaaaaacaactgtcgggttttaaagaatatggatgtccgggcacccacctggagctggtgaatcagaatctcaggagtgggacctggacctgtatgtttccttctatttccttctatttaaattcccccaggagatttgatgcacttaaaagccaatctccaaacttctattgaataccttgtgtttgtttttaaatatcagtctaagaatttgctttctagatgctgtccatgaaaaaggcaaactggatatggagtaccacatgattcaaaactggggattttgttcttaaatagctaagtgatgcccacctggaagggtagttatgggagatgaaggcaggactatgcctggagcctggaagttatcaggaagtagtttttttttttttttttttgagacggagtcttgctctgttgcccagggggagtactgtggcatgatctcaactcactgcaacctatacctcttgggttcgagcgattctcctgcctcagcctcccaagtagctgggattacaggtgcccaccaccatgcccagctaattttttgtatttttagtagagatggggttttcccatgttggccaggctgttctcaaaactcctgacctcaggtgatccacccaccacggcctcccaaagtgctgggattacaggcgtgagccatcacacctggccaggaagcagatttttgttcagtggaaggaagaacttactaagagcttgagctgtccaagaacaggagaattggctgctttgctctgcagtcactggaatattctggcagaggctgggtgatggaggagtctgtgctgaagctctcacctgaggtagctgatggagaaagggcaaagtaagagggtggagaagagcaattaagaatggacagtttgttgttaaaaacaaaacactggccaggcatggtggctcacacctgtaatcccagcactctgggaggccaagaggcaggcacatcacttgaggtcaggagttcgagaccacctggccaatatggtaaaaccccatctctactaaaaatacaaaaattagccagatgtggtggcgggcacctgtagtcctagctactggggaggctgaggcaggagaatcgcttgaacccaggaggcagaggttgcagtgagccaagatgtcaccactgcactccagcctgggtgacagagtgagaccctgcctcaaaaaacaaacaaaaacaacacttctcaccccttcttattttaatattaacactgcaaaggcattttctcaagttacttgttttttttttttttttaaagacagggtctcactgtgtcacccaggctggagtgcagtggtaccatcatcatagctcactgcaacctcaaattcctgggctcaagcaatccccaagtttttctaataatagtggtgttttaaatttttttaactgtggccaaatagacataaaattgaccattttgaccatttgtaaatatacaattcagtggcattaggtgcattcacatgttgtgcagccatcaccaccatccacagaacttttcttgcaaaactgtaactgtacccactgaacactgactcccctgtccaccacccccattcaccggcagtcatcattctactttctgtctccatgaatttgtctactctagatacctcatatgagtgcagtcatacagtatttgtcctttttctaatagtgtttcaattacaacagggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaaggtgaggccgactctgcccaaactcagatgcccacgagtgggctgcgcggcagtgggagctgagcgaggagaggcccagccagcgtcatggcagagacggggatggggccaggtaggagatcgagttagaaaacctaacgataaaagaagccccactcaccacaccccgtctaaacaatataattgagaaggattattctgttgtcatgaaagaacccacaaaactaaaaatatagagacaaatcatgttttccctggatgagaagactaaaaatgatttaaaatgtgaaatgttctgaaatgggcctaatgtatttctgtcaaaatcccaacaaggtttctcttagagcttgggaaggcaatgttaaagttcatctggagtaaaactgtgaaatagcaaggagtggctgggcggagcggggtgggtgggagggaacaaagagttcttgccgatcctcatggccttatccagtgttaaaacaagtactcaagttcaactaattaaaatacttggtttcattttaaaatggctggtaagtgtttgttgtatttttagtgtcagagtcacagaatagtcaggtaaaagcttgagtatggttgctagacttttaagttagtttctgtaattatttattaaacattattagcaacagctgtcactacttgactaactacataacaccagctgcttcatggacatgatcagtgcctacaataaccttgcaaaacccttattaacatcgctattagtaaaactctaaaaactgagatgtaatttacccaaacacacccagctagtaagtgacagggccaggattcagaatttgaactagcagaggcagaagctcacactctttcccctaaagaagaggttggcaatctacagttaaaggccagatcgggcctgtggcctgtttctacaagtccagctgccctcatttattcaggtactgaggctgtcttgtgctacagtggcaaaggtgagtagttgcgacagagactatggcccacagagtctaaagtgggtgctacctaatcatttacagaaaaagctgggcagcctgtgccctaaaacttgttgtcccccaagctgctctaatcaagacatacagctctgctcagttattcagggacatttactctaagaagcaagagatttggtggcctgcagtggctgcgagggcagcctgacttctctggcctggtgcagaatgtctcctggagaccagctgagggggccaagagctcaggtgactttcctttgcatcaatgtagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcaggtacctaagtgggtggtctgggcatggaggagaaaggcaagcattctgcttaccagtggttcccattccagccacggctggaataaagaactcagttgtgagagggtcactttcaacaagccacctatgaaagaataccttctcccactctcactcttagacaagtctttgctaatttccataaaagtgtggttaaaattacttgtaaatgtcattctacatatttcccggggattcgatccagataaattgttgaattccgtagaatgccaggagaggctgaccacatgtgagtcacaaggtggctctcattgcctttaggcctggaaggcctgtcacagaccagccttcgtgcctgaccagccccaaacagccctcctcatggactctgctctcggattgctttttctagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcaggtatgcttggggtttacttatatctggggcaaccaataataacagcagtaataacaatggcctatattaatcgagtccttactgtgtaccaggcaatgtgctaactcactcttcaccagaactccttaagtagttactttttccatattttataaatgtagaaacagaggcttagagaatttaagaacgtggaggaaatagaatttaaaataataaagagtaagaaaaacaggaaacacaagccctaatcatctttaatctgcccctcaccacctcctcttcagagtttcctgatttctagttttctggggctacacctaagccttgtgccgcttctggtatttattcatgtctttcccaactctactgggtagaatggcccctccatacgtgggccctggactccagccagtgggcctggagtgaaagctcatccctgggtcccaggggaactgaccggtggaagggagggagagggttccactgctgggactgatccctaaaaacagaatgatttctctagcactcaagaaatctgcgtttgtgagctggcctggagctggatattcactgtaaaaggagagaggatgtatttattcattcaactatttgctgaaccgggcactatgctagacttttagatggacaaaatgagactggtcccgtaaccacccaaggggttcaccttgccggctgcctagacagagcccatttctcaagacaggggaattgcaatagagaaagagtaattcacgcagagctggctgtgcgggagaccggagttttattattactcaaattggtctccctgagcattccggaagcagagttgttaaggataatttggtgggtggggggaagccagtgaaccaggagtgctaattggtcagagatgaaatcatagggagttgaagctgtcttcctgcactaagtcacttcctgggtgggggccacaagatcagatgagccagtgtattgatctgggtggggccagctgatccatcaagtgcacggtctgcaaaatatctcaagcgctgaatttaggagcagtttgagggtcagaatcttgtagcctccagctacatgactcctaaaccataatttctaatcttttggctaatgttaatcctacaaaggcaatctggtccccaggcaagaaggaggtctgctttgggaaagggctgctaccatctttgtttaaaccataaactataaactttctcccaaagttagttcagcctacatccaggaatgaacaaggacagcatggaggttagaaacaagatggagccagttaagttagatctctttcactgtctcaatcataattttgcaaaggcagtttcagtccctgcttcctggagcttgctctataacagagaagacaagcactaaacagacaatcacaaaatataaatataattacaaattgtgattatgtgccaagaaggaaaagtacagcattccggggagcatgtaacaaggtgctgaatttagatgcacttcctctcagcaagtgatatttaagctgaggtctgcagggtgtgtaggtgttagccaacagagaggtgggaacattgttccaggccatctgcatgaaagccctgaggcaggaaagagctcagcttcccagctcattccaggagaagcactgcagggagagaggaagctgaacaggaagggcagcagccattcactgcaaatgtcttgatggtaggaaaaatggtctgtttcctttagaagactcccagagcaccgaggttcaggttctagacacctcagagatcatctgtgtcacccactgtccatgagaaacctgccttacctctgtaccaaaggttcttggtttcctgtgaactgggattcctgtgtatcagaaacacctggcggctttgttacagcagagactgctgggccccaccctttcggtgtctgtctgggtaggtttggggtggggcccaaaaatttgcatttctaacacatttctagatgcagctgacgttgctggtcgggaaccacactcagagaaccgctatcttaggactctggaaaatagcgagaaaatggatgagaagaaagatgggaaaatggcctgctgttgttgtcatgggctggccataggctttgcagcctggagctgagcttgggtttggagaaaagccctagggatgcagaggctgggcagtgttctgggaaactgtgcccaaagggagtctgtgggactgagaaagaacgttgatgaacatggcttcccttctacctacaggtgtcaacaggtgcctataagcgccaggtgcatgaggtccccctggggaagcaggtaactgaagccgtggtcattgagaagatcacctgggcctcctggacaaggtgactgactggaagaaaaaacttgaggaaaaggtcacaagggagtctcttgtctcactcaggctcagcctccaagtctgtgcaggatctgaagaagctgagaaatggagctgtcttttcttttgggggtgagggtgggaggcttcttggctagtctagtttaggtcactggctttgatctgacctaggtttttgaaatgcgaagcccctctttttgtgtaatttcttctacaagtctccaaccccttccagcaagttcaacaggaaaccatctcccgtctcttggccaatcctagtgcacagtgaggcctccattcgctaggggaagggagtgggagggccagaccccggcttagcaggatgagaaacaatggctaattcatgggaaaagagaccatttagtctgtgagttgaaaggaacccctgctgttctccccaacacacacatattcaagaggaccacagggaacagggagagaatcaaagatgggggtaacttgtgtttttggagtgtagggaactgaggcagagggggaacagtaagagctggcacaaatgtacagaggggaaggggacagatgctttcatgccaggagagccacatggctgtactgaattacataaaacagcaccagggaccaatttcatggaatacaatttttccagagaccaggtagggggtggggtttcgggatgaaactgttccacctcataaggagcttgcaacctagatccctcgcatgcttagttcacaatagggttcgcactcctatgagactctaatgctgcggcagatctgacaggaggcggagttcaggtggtaatgctccgccaccactgctcacctcctgccctgcggtcggttcctaacaggccatggaccagtaccgttccgtggcctggctgttggggacccctgatgttaaacatccctctcttccttatccctgggaggtgatgactgactgcaaggagccttcgccgtgacttccttctatcctaacccctctttctgttggaacagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgtgagtgttcctcagagtaacctccctgcaggttctctgtttggccgtctgcaggagataggggccacgtctagatggccctctgggagacacagagaaaccctgtcccggtacagtggaaatatggcaatgagtttttcacctcctggaggggcagtcctggaagccagaagggaggatggagggtggataaaatgacctgaagtggggcaaggatgagaggcaggaaagtcagccaaaggctggctaatagatgagtccagaccaaatggaagtccccagtgaaggaaggttctgggagcaggggatttgagtgctggaagtagtctgtggttgctgagaggagccagggtctcttagctgtctccattcacttttgctcacaggccaaacataagcgatacttcggtcactcggctcacgtgacgaacatccgtttctcttatgatgacaagtatgtggtcagcactggaggagacgactgcaggtactaacgtagctgacccagttcttactccacaggcctggccagctctccctccccatctcaggcatcccgtgggtcagcctctcccaggggcatgaggagggctgatgtggggctaataaacaggaaattccatgagtcctcatgaaggcaagtactttccaagataaggcatttactctttggtgactgtcaacccaatggttgtgactggagctgtcctgggatggcatgggcatgtgatagctactctgggcactgctgggggaaagggacaggtggatgacacccgagatggctgatttgagtagaagctcttggcagcccatgggcttttgtgcataatcaggaggttagaatgcaaattcatctatatgtccttttaagaactcccagttgatcaccagtgttgggaatttctttatttactctaaatagagtatagaggaacaggtctaggtcattctaactcactcagcttccccatttctgatgagcttcattgtagcatgaatactgggttctattcagcccaagcaaaactcctgaggggataaagatgaaatacaggccttctgatacttcctggtggtctgagttaggttgtaagaaaggcacctataaagaatctcaacccacttcccactcaaaagcactgtgtatttctcatggcctgcctgggagcccccatctccagcctgctgtgctggctacttctggcacttatagcccttgagatagtaccgccagcagctccctgtgaagtgctaacaccccttcaaagcagcaccaacccaattgtgaacaagctaggagtaaaagacgtaaatgaattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccagaagtcctcacggaccaacatttagcacagacattcaaactgctgaaagaaccaaacagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaa

SEQ ID NO: 1406 - DNA, 73117 bp, Homo sapiens
ttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttttgccactctaaatatagcagaaaacaaaataaaataaataagataatctttgctgcctccaggtgccctctgagggacagacagctgctccagagttgttcatgaggacaaaaagcccaggcagcctggagacccagctgctctgggtgagccttagctcacttcctgtggttcctgggacttaccaggcccacccccatgcgcatttctccaggcaggttctgaggactctttggacaatttctctttcttctcaacccttcaatctcctaatccacccccctacccccaatattttcatagaaactaagggaattttggaggtgaaagaagtcatctagtttccagtgtccaccctccccattctacagatggggaaaccaaggcacagagagggcagtgccttgcccaaggtcattcggtgagtcagtggtggagcaggcctgaggcccaggtcccccagttcccaccccgttctgcagcccacccctcagtcggccttgggcagggacttcctgtgcgaggggggcacgaggtgggggggcaggctgctgggcagctcgtagccgtcgagcttgatcttgatgaggtgcttggccagcgcgaactcctcctcatcaagcatgccgtcgcagtcgcagtcggccagcttccagatcttgcccaggacgctgttgggcagcttggaggtcaccatctccttcttggcgttgacacctgatatcttgccattgatgggcgacagagtgtagaagagctcgtcgtagacgggcttgtctttggccacgacccactcctcctcgtcggcgccctccttggcaccctccccgtagccctggttgaaggggccctcggtggtgccatcgaaggcgccgccctgcaccagctgcgtgggcgtgctcgtctcctcctggctgatgaggttcatgaggggcgagatcttgttgctcagcatgttgtccactgcctcgatcagcttgggcttcagcgagtggaatttggtgaagtcatagttctcaagctgttcctgcagaaggacaaaccacaggatgggttacatgtggtctcttcagggggaaacagttgggggccactggagggagactaattctgccccaggcagacgtcccacccactactcaggagtgcactctttgggagcttcccacatccagatgtaccacatataggagtggttgttttggaacaagaaacaagtgtttttcctatggcagccaatctctgctggtggccgcatgagcgacagcaacctccgaggactctgagaaaccttctttcacctgcctttttaaaaatgctctagagttagtattctatttctcaagggatttcactacacacttcagccgatcttcatagcaatcctgggaggaaggaggggcaggcatttagaaccacattttacagagagctgtgaggggctgtctggcagagtcaaagcagagcccctgtctcctggctcttgactaatgctctctgtgctggaacacagagctgtgacagaaggactatgtttacataaaacaactaattaaataccttgttttcggaacacgtaaaaaaatgtagtgtaggacagcttcttagtggctctaacctcttatgaatgagctgagggcgctactcaacaggaaccccgtaggaccagccccaccaagtacggcctgaccaggggcacctgtgctaccccaggaaggtatcgaggcagggccacggagaccttgcatatacaacataatcatcatgaatccactgtcatttctaaaatatggacaaataagcaaaagctggaacttgtaagagcagggagtagggctggggagcacgagggaataaacgtagctggtaagcctgagtatcactggccaggtcaggacatatcttagctctacctgttgagtgaggcagcctgtcagcagacagagcagcagaagcacaggctctagagggggcctgggaaacactgtgactgcccaaccaggctggggcagactacaggatgccacagaggctctgtggatggcaccgtagaaactgaccttcctaccttggttctccttggttactccatccatccatccatccatccatccatccatccatccatccatccatccaacaacccacctgtccaactaatcctccaactaaccatccatccattcaaccaaccctccatccatccattcagccaacaattcatccatccatccacctacccgaccaacttttatttgtcatttactctgcaccagcccctgttctggggcttggggatacagaataaatatgaaaagccataattcctgctttaaatgagcttatgttgtaatggaggaaggatactccaattgtttaaaaaaggacttgacataacacagtgaaaaggataacatgaaatctataaagtcattagaaagaaaaaagccaagtcattaaaagggagagaggggccaggctcagtggctcacacctgtaatcccagcactttgggaggtcaaggtgggaagactgcttgagcccaggagttcaagaccagcctggtcattagacccatatatatatatatacatatgtatgtgtatacatatatgtatgtgtgtatatatatgtatgtgtatatatatgtatgtgtatatatatgtatgtatatatatacatatgtatatatatatgttagggagaggaagggaataatcacatcagatggctaaggttaaggaaaactaccgcctgtataaggagaagagctcagttgcccagggggacccctggggaccctcactgtctaaggagagaaaacacttgtttattgcaagagacaaactttctgtggctctgaactgcgagagttacctagagctttacatgacaggcttcaaagatctgatgaaaagtgtcttcaacagtagttttattaaataaatgcagaaatgttccaggtatggcaggttttatatgtgaagtatttctgtatgtacagttctagagggggccaaagagaggccatgcaggtgtgcaattttctggagatgaggcagggagatttgcaaggaaaagtcagacctcgctgttttggacagaagcaatgtgacaggctgctaggaaaaaaaaaaaaaaacttggtgttatcataaatatcatgctttcttgtaaaaaaaaaaaacagaaaaaactggtaagcaaaactaaaaatttaaaataatttataatctcatcatctggcaaaaacctctgctagcatatctgggcatgcatttctagccattaacatacatacacacacacacacacacacacacacacacacacacactgaaacaataccacactcttaacaaataatatgtcatatatttctgtggtattaatttttacataacctttctcttaacagttacagaatattgaacttagactgtagagctgggccattcttaattaaccctgtcccctatagctggacacacaggttgtttccaatagagaatcaaaatcatggtctctagggtggcagggcaggaattctgggctgacatttggaaggggattcctgggtggtagttggtggggggacagagctgagaaatatcagctaaacgggctgacatttctctagggaagggactctgacatattctcaggaagtaaagtcagcagccatcaaaccatgcaaacccagcgtgtggcccctgctcagctcagagcagcgggtactgcaggccgggtctctcaaacgcagtcactagcatgtcactcctgacatcagcaccaaacaatgcggcctgcacttcgggctcctgccaccaacatctcaatgggccaaggagatggaaaagagaacgctaagcaggtggaggagcaggcgtcccccacaaaaatcccagtgctgctgggtcaacgagtttggattccccgggtgcgtgaacacctaccccatttccttaagaatgagcctgcgctcagagcgcacacagagcccctgtgtctggcccagcagacaaaggagggtgatgcctgcccaaacttcccaccagcctgcaggggccgtggattccgactgcagagctctggaaaactggcagggggagtggccgcatatttgcaggggtggacaggaggcagcagttattcctgtcctgggaggcaggcaagaaataaaccctccattctcatccctgtggtcccccccaggcttgaccggggactgcgggggcaccagttaaaccatcatcatgtcactcctgacatcagcaccaaaccatcatcatccctgccctctgccacggtgagtccaaaacagttcttattgggatgaatacacactggggaacttaaaggtatttgcccatcaacagttgtatccactaagccaggaccctggaattgctccctctcaagaggcaaaggtcagttcccagccccgtctctggtggggctgtcccttgcccattaattgccaacattaaccagaagagttttcaaatccaccagagggtctgagcagatggggctgactctgctgccctctgctgttgaaatgctgccaactcatgagctgaggggtccaaattctccttccagtcagaggagcagagtcagcagtaacggtggcccttcgggtgctcatcttgtcctgcagtattaacactgtgctgtcagtcacggtccctccccagagcgtgccaggcacgcacaggcagccacacaggtgggttgcagggcctgtcccagctcagggaagggccttcagaatacactctcctctcactgctacagctaagagtcactctgaccagctggctccatgagagaacagggagaataacaacctaaagctggcatcagcgagctctctgcgtgaccctgatatgtgcaaagatcacagtgtggtcacttctaagcgtatgtcccccctctgtcaaggcctatgttacagaggatgttagactttaacagcctcagggatgggacaggccctaacccacacacgcgcccctcaaagcttccggtgacagcaagctagcttgcagtatcaggtgacactaagcattcctgacaggctccaggctgccttgttccttggggattctccgaaggaatggggtgatgtgactgggcctcagcctacttcccaaggaggcctcttcctgcagcttctaggggttggcacggggaacccctggtctataagccctgtgggaatcgaggctgcgtcagggcctgagagcctgctgtgatatggccttacactaacttactaattcacttggcttgtgtgaattgagcactcaccacgtcctagatgctggggatatggcagtgaacagggcatgggtcactgacctcatggagccacagacttacgtgggagagagatactaaatatcagacatcagataattcaattacatggaagcacaacagtgctcatattgtaacaagaaacatgtgtccttacagtggggttgctgtcaattatttttacccccatttgttcattttttctgttttttgacagggtctcctctgtcgcccaggctggagtgcagtggcgtgatcatggctcatagcagcctcgacctccgggcttaagccatcctcccacctcaccctctcaactggctgggaacacaggcatgagccaaccacacctggctaattttaaaatattttaatggatatcgggtcccactatgttgcccaggttgttctccaacccctggactcaagcagtcctcccatttcagactcccaaagtgctgggattacaggcgtaagccactatgtccagcctcatttgttcatttttttgtgttgatttattccaggggcctagaacagtgatagcagcaggaggcagaaaaatgctgaggcagataggggtgggtctccagtgaaaccctatcttcaagccaaaggcagtttaaagcctgcaggccaagctacaagtcaaatccatggactggattgagaacctgtctttccatttggctgcttttctttgattgatcctcacccttcacctattttacatatacctacccttccctaattgtttttacactgttatgtccacctttgactggtgcctttgttttaaccttttttgcatactcacaaatcaatcagcatgcactcctctatcctgtgcctataaaaaccccagactcagccacactggggagatgacctgacttcaggagagacaacccaatcttcccatcccctcttcactgagagttgttttgttgctcagtaaaatcctccaccctcatcactcttcaattgtcagcatgaccttattcttcttggatgcaggacaaaagcttgggacccaccaaacgcaggtacccagaaaggctgtaacactggccctctgccctcaccattgcagggtagccgtgccactcaacagaagcagtggtggggtcgagctggaccggagccatgggccagagtggggcaagagggtgactgagctgctaacatgatgcacaactaaaagagctaattagcacactgtagcaccccctctggggctttggggttgcgggcatccctgcctgggcactgccacgttccccttggggtgacacacctggtctggctgcagaccatgcacagagcctgctcctatgtcagcacttggagtggctggctggatcctgcacttgcttgctcacccaccttccgtggtgctaaggtactgggcatagacctgagtccaggtgattctcagcaaaggcttggccctccttgtaccctccatctcagtgggccatggctgctcctgagatcatgctttccttgttgccttcccccagctcagaggaccctgggtgtcttctgacctggccagcccaggctagctttgtcatgagtagctctggtcccagagcctgctccctacattatcgggctcacaggggaccagcaggagaggcctggcaagggaggcctctgtggagccccagggctcaagagcagcgtctccctgtggcaaggcactgtagcaacttcaggaagccagcgaggcacagaggccccaactgggccacagctcaggctctgtatttctttataactttcatttaggtcaagaaaccaagttcccttctgaaatatctgaagggtacaaggaaacagctgtcttactccttggtcatgggatacagggcataaccaggggtgtgaatggggaagttgcccagggagactgctcctggaggccacaacagccctccaataccacctggtgaccagaaaaacccaattcagcttgtgagcacaggaatacccatttcactgctggaagaaaagagacatttctctgttgtgtgtgcgtgtatatatttttttgagacggggtcttacactgttgtcctggctggagtgcagtggtgcgatcttggctcactgcaaccttcacctccagggctcaagtaatcctcctacctcagcctcccgggtagctggaactacagacatgcaccaccacacctggccaatttttttggattttctgcagagacggggtttcactacgttgcacaggctggtctcttgactcctaagctcaagtgatctgtccgccttggcctcccaaagtgtagggattacaggtgtgagccactgcgcccaggctctgtgtgtgtgtgtgtgtgtgtgtgtgtgtgtgtgtgtgtgtgtgtgtatatatttatttattttttgagatggggtctgcctgtgtcacccaggctggagtacagcagtgcgatctcagttcactgcaacctctgcctcccaggttcaacaaattctcctgcctcagcctccaaagtagctgtgattatagccaccacacccggctaatttttgtatttttagtagagacagggttttaccatgttggccaggctggtcttgaactcctgacctcaggtgatctgcctgcatccgcctcccaaagtgctgagattacaggcatgagccatcacacccggccctctgaatatattttaaaataaatacagctaaagcatattgggtcagatcaaatatattagactgattcactctgaatccaggtgtaaagagctgtcatcaaaacagcaagaaaaacccacctctgagttagtgtataatttatataaagcttgcattaaaaaaccccttaggatcaaagttcccctctcatcacctgctggcccttgcctcttctgcccgaccttcccttctccctgtatcctctctgctttcacctttccctcctcctgcctcgggctgtacctgcttgcagtttttaatctatgctggcttcaatgctgtcactctgtggctcaaggcaaaagatggtaactggtggtctctgtgtgcagcccatatgcaggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggcccccagggcagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtccagcagcgtccgcagagccccacagcccctgctggagcccttgagcctgcagcagcaaggctgcctgagcacataatcccacggcgtgaggcaggtcagggcagggctggaggaggccgcccaaggtgaccctgaaggccactcccagctgtgattccctcacagttctgggattccaatgtcaccgcaacatcaaccagcctccttggacacagtctaagagggctgctcacctgactttctcatgggagcttcatttacctttggccatgtgtttcctttgtttacgcattttggaagacaggcaatttctgctttattcatagcctattatcatggatcaccattaggaagatgcgttgtccttgatcctaaaccatgggactctcatttgtctccagcaaacagccagacaatgtggcactgcacctctgccctctgcccgtgacattgtagtgggctcccagtacctgcatagccttgacctcagggaagtcccctgcagaaatctggtattctcgctgtagctgaatgtagatttccggtagcctgctgataagctctctcttcttgttttcctttccaaatacacttggcatctccttcttcaggtagctgatgatgtaggcatgcacctggaggggtatagatcaggcagggaagtgtcatttagaattgcatcagagaaggaacaaacaagattgcatcttaactccatcataacacataacaggtacccacacaaaccaggtcccaaggacaggaggaggggagggtccagggggagtggagctgtccaagggtggccggaatgtggccagacttggggaaattctacggctactgttctgttgtgcctctgagtggcaattctggtgtctgtagggagtgagtggtatgggtggggcctgggtgggagagctcttagttctggcaattaaccagaatacccaggagaaagtttcaccaggctggtgcctgggagcaacaggaaatgaaactggaggctggcatcaatggctgatcaacatggaaatctgtacccagtgaacgatgagatgagaatccccataacccccctgttatgggaggtttagactctgagatctctacaggtggaattaaagtcattctgcacaagaccagctgcctgggatcaggctggatggcagaagatccccctgggagaggagcccagaagccccagaaaccttgatcactggggcttggggtagccagcaggctgtcattggaggggcgagaatctggcctcaacatttccactcttctactgatttccaacttcaggatattaagaaatgttcactacaaaagttctctttgtatatatatatttttgagatggaatctcgctctgttgcccaggctggagtggaacagcgtgatcttggctcactgcaacctccacctcctggttcaagcgattttcctgcttcagcctcccgagtagctgggattacaggtgtgcaccaccacgcctggctaatttttgtatttttagtagagacggggtttcaccatgttggccaggctggtctcgaactcctgacctcaggtgatccacccaccttggcctcccaaagtgctgggattacaggcatgaaccaccatgcccggctactttgtatatcttgaacttcagagtaattgtgaagtcaagtaagtaactaaaataagaaaggatgaaaaacagagtggtgattacaaaaagaaaatgactatgtagcaacggaaaatcctattaaagaaaacagacttctactgtaatcttgtagaagttgaaattaaataaagggggtaagcagatacattccatagctcagctgagggcccgtgtgtggacacatgctggacacagccaaaaacattttgtgaggatttggatgctaacctaagtacctaatgcaaggtctgacatgctgaggtcagacaatgtcaacttcccatctgcacaagggtcgtttaacagaagcatgcactgtgcagcctggctaccgctgagaggatggtcttggagagatgacgctaaacctttctgtcaccagcaaacttgtttatgtacttatttttcaaatgaagacaattgaaatgatttacaagattcttagagataacttgagaaacccgaagtttgggatccgttatttagaatcctgggctttaaccgctgtgatgagcaagtggtaagataccaactcctttgcctccgacagtgaatgcctggcttggtgtgggtgggctggggagggccagggctgagggagcacccttggactggaggagctgccacgttccatcagggagaaccagctgctcaccagctgtccttgcatcatttccttggcctccaccttcctggaaattctggattgggcctatgagtatgttctctatgtatacctatgtatacctctctcttctgtgctcaggctcaccccaccctggagccaccccaagggaagcaggaggcccccacagctgctcagtctcccaaacacaagggcttcttattgagaccacccccttccctgctctggggcctagccctggagcagctgcctaggcctctgtagggcttcccaagagccctcaccacgtactagtaaggtacctctgagccgccaggccccagctcagggagggcttagttcccgctcatctggctgactcctcacccactccctgccgcccaccccccgaggttgggcacactgttcctgaacactccctggtgcccagggcctgctttacctgcactgaactcagctgatgtgcacctgccacacccttcacccactgagtgtcacctgatccctcgtctcaggcctcatggtgtttgctggctgatgaccgaggtggccccgacactaggccttcacagccctgataaacctggggctgatcttgtgccaggtctcaactccctcctccttccgccagcttggtgccacctgagtcatgacccttaggtgacctgctcacactgcagctgctctcggtcccagcctccacttctaggaagttctgttagcgaggtttgtggaagtctcctgttacgctgcctctgcatgtccacccgcgtcctgcccttcctggtgcgccctaaacaataacccagggccaacttctgtgcacagacctgctttcagaagttcatcaagttggccaggcacgatggctcatgcctgtaatcccagcactttgggaggctgaggcaggtgggtcacttaaggtcaggagtttgagactagcctggccaatgtggtgaaaccctgtctctactaaaaatacaaaaattagctgggtgtggtggtgtgctcctatagtctcagctactcgggaggctgaagcaggagaatagcttgaacccgggaggcagaggtcacagtgagctgagattgccccactgcactccagcctgggtgacacagcaagaatccatctcaaaaaaagaaaaaaaaattcatcaagtcacaaggtaaattataatccttagcatcatgaaatactgaatctggaagtgaccccccaatatctactttaattcctggttccaggacatccatgtgactcactcaaggtcatacagctagttggtagatacagagctggcactagcatccaagtgcctcgttcctgtccctaaagaactaatgactccctgtgggtatgccctgtgggtatgcattaataatcttactgaagttgttcaaaatctggaattcaaaatgaactgtgtcccatagaatgagtctggaaaactttgatctgaggtttgacttctgctcgtgcctaattcactgagaggctttggaagggtcctttattctccctttccccacacatcaaacacggacacaatgatggcacacaaacgtcgggacaccacgtgggaatgcgggtgaagactgcgagctgctggcaggatggcatcctgtcattttctaaagtcttctggtaaacagacgggacagcttgaatgactaaaatccacagtcagcctccagagatcactcctgcaattatgtgtcaaaggtgtctccaaatacatgccagacccagggccagacctggtggttgtccctggggaaggaggtggaaacacttgggtcttctgacctttataatgagagaaaactaattgggaagaggaggagtacgaaagagaagagggggactagacctggagcttgaagatgaggctcaggccccgtgaccactgcctacccactgagcaacttggggccaggcatggcatctccacctcagcgtgctcatccacaaattagaaatgacaacaacattcatctcacagagttattatgagaataaaagaggtcatgtatttgaatgcactctgctcactagaaagaggagcaaatgttaacttgttatcaactaatggccaaagaccaacagctggaggtacagtaatgagagagagggctcccggctggttactccttaccaaataattaataaactctctctatttaaatagtaatataatgaatttgggttccaagtgtttaatttacattgacccctgggggcttttgaacattcgtatcttgttcaagtcatcctttgccttgtgtaaacttgcagaagccctaaggcatctaatggggatgactgggggaaatcaaatggatcaaaatgacaaaatgacaatttttctctaggctaataactcaatgagcagaaaggaaagtccttccttttaaatgtatatgaatgtatatgtagttcacacgtacactctgacacagatctcattgtgtccaatgatgtgtgtgtgtgtgtgtgcctccaagactgagacacatgtactaaagagtgatactggccacatctactctgggcttggagggtaacttcagcgagtgctggatgctggaagcgaccagtgctggaatgaaaagcttcatggaatgtgaggatcaggcagtagtttggggaaggcgggctgggaaggcatggtgacacactgtgccacgctcatctgcaaacttaacgcaacctgctggagacctgcggctggaagcccagctctggaaacctgcatagagtatttaaagccagggtatcagcacgtttataaagtgggtttatgataatataaaaaattcagttaataagcctgagacccaaaagatgaacccatggggtaacaagagtgtgagactgtgagaggcagagaagggcagctgacttgagcaagggtttgttattctgctcagatcaaaactggcaccaatggcacgtgtaattccgtgcagccttaaaggggaccggagggggctgcacacttgtctgaggtcaaccttcaaagagacaggcttccatttatgggctcaagcactgacacacacacatccacagtagctcagggctgctgactgagttatttttagagccctgccgaggactaggcaataccaggatcttcatgatccattatatcatgattctcacacgctttagcctgaatccatttggtgcacaaaaaatgcctcatttctttacaggagaattttttttttttttttttgaaatggagtcttgctttgtcgcccaggctggagtgcagtggcacgatcctggttgactgcaacctccaactcttgggttcaagtgattctcctgcctcagcctcctgagtagccaggattacaggcgcccacctccacgcccagctaatttttgtattttttgtaatttttttgtaattttttttgtaatttttgtatccagcacttgctgaagttaccctccaagcccagagtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaactacagtgaaccttgaaaatcactgacctctcctcttctttctcagttttacttgtttcttcctcaaatgttgcctcatttttgttgagcaaagatctccaaatgggtgacagcctttcctattcttgggcaatacgcttctaaagggtggggtctgatagtgaacttgcattgtttgggatttgtatgagtctaatttctttaatttggctattttaattatagctgaataaaagtaaatgacatgttccaaacccttttttgggctttcccaaaacagcttcctttaaagaatcatgaaatgaaccctgattggcatctcagagtgtgagccgtcttccaagaaggatgtctactgagattgtaagaagtgatctttgaggctaaccaaaaacccactctaaagtttccctgttccttaaatacagagatgtgaaaaaaatatacaaacagaaaaagaagggaaataaacttcaagagctctttgggaagagtatctatctacttttcatattattaaaatgtcacctttatgacacttcgagtttgattaaaacggcgcacttgctttatctggatgggccatgaatcctggttaattatggtgttctataaataaacatactccacaacccaactcagacttgacatctcttagctgacatctgaaaacttaccctttgcatgttttcaaagtgtcagcttgataaacctaaactttgtagggtttctgtggatggagacttttatggaataaatagattaacagatcagtgcagaaaacaaggacacagggaggaggtactgtagctgctgttcactcccgatttcaggtgactgctttctggactgaggtgtcacactgaccgaggtttgaacgtatactttgcagcttacaggctgtgaagcctcggggacataacttcacctttctgagcttccgttccctcaggtgggaaatgaggacaaaaatgcccaactgtgtagttgtcaacaggatcaaacaaaaaaacacacataatgcagactacagagctttggaacagttggtgtgaaaaaggaaaactggatcaagagaaaggttaataaaccaaaataaaagcacttttggaaaatataaacactccaaaaagaaaaactcaggtaagcatctgtccatttaagcagaaacaagttcagcggtggaacatgaaactgcaggtggcgtgaggtcaatgtcatgagttagtggccaaggccgccgtgctgagtccggcttctcctccgggtgagcccgcttcctgtccccgttcctcagcatggcactgcccacgagcaactggcactgagaagctccggctgcaaatacccatacttcaaacattttcctttgtgaaaaggaacaagccagatactattcttaggaagaaaaaaaccacaagcctttttcctgcaagtaagctcagcaagtttgaccgtcccccactccctgcatccacacaagggttttcattattcacagtgtcagaatacagagcagcgttctgtgcctccaaacccaggccgcgctggcccgttcagagggcccgaggctcaaggatggcagggaagctctacgggttaaggcgcttggcatttccagcgagctttctgctccttatttatttatttatttatttatttatttatttatttatttgagacagagtctcactctgtcgcctaggctggagtgcagtggcacgatcttggctcactgcaacctccacctcctgggttcaagcgattctcctgcctcagcctcctgagtagctgggattacaggtgcctgccaccatgcctggctaatttttgtatttttagtagagacggggtttcaatatgttggccagactggccttgaactcctgactttgtgatccacccgcctccgactcccaaagtgctgggattacaggcgtaagccaccgtgcccggcctccttatttatttatatgactgaatacagcagcatctccagtcactgggtcttcatttaccaataactggtaaatgaagaatgtccatgagcatttaaaaatagttttaaaaaatctcaaaatctgcaaaggctatgacatgagtcaccaactttggttataaactaatgtggggtgtcacacaccttgaaggttgttcagttgtacctgctggagaaaggaaacaccacaaaccaagggatcaccgagtggaaaaacagccttcctgctaccaagcattaggcccaggacaagggcgagggcaaaatcatttcaggagagctgcacgtaagtggatttacaaactagttagcacatctgccttgcagaactggagcaaaaatggcttgtagctctggaaaggaagccacttggaccaggaagaacagataaagaaggatgactcacacaagcaccacaccactgcaggttagctgagccatatgggaggaatgcatgcacacgcactgggacacacgtgacagagagggacacaggacatcgaggtcctgtgtgaggggcagcagcagccaggacggtgtttgttttcacccaggcaagaggctgcccagtgagcacactggcacgaggacaggctgctaatgagcagcaagaaggaggaagaattgtccccaccttggctgtccccatcagggaagccctccctgcctcctggccaggcacgtagtcacccttcccagagcactcatggcagcatccataccatgactggcacatagccaatcacccagggagctttacacacacacacacacacacacacacgcgcatgtttacacacatgcatattcacacaaggccatgtgtgcacgcacacccctatatccgaggctctggggcagggcctgggaatgtatgttgcttctgatgatcagccaggtttgaacttcactaggactagataaaactctaaaggcacttccagcattagaggacaatgattttatgaaacatgcacatattttttaaagagccatttttttctctgtattttctcttggaggagggatatgcttttctctctttggagacatgaattgactctgtcacttgagggatgtcagcaggtcacctctcactgccccattgggcacacactcctggggctgctgaaaggctcagctatgaggcaggcgagccaggagcccaggcatgcaggctaacagcccgcagcccagaatgaggatgcgggggtgacccaaaaccagcacactccaagagtaagactgagccatacttcttcccagggctcccctggatccaggtggtaacactggcctttggtgcacggggactagcagtggcctctcagcatcctgttggtctcaccaatgccacctctttcaggtttggttggttatattcctatcgtcctgacatcctaacagctaccatgtagtgggtgcactgattgatccccctccctgtgcaccaggcactatgccaagtgctctgtcacactgaccaactgtcaccccaagttcttgtgaagtgctcttattagctccatggtacagattggagaacagggttagtcatctgcccaggagtgcagagccaggagctagggtgtcagcagggccacctgacctcgaggctgtattcttaacctagcgcatgttcattccttaagccttctggaacgaagcctcctcccacccatcttgcctctggagaggagacagcagagtcccagcccctggcctctgtgcaaggcatctcctggcttaccttggccagcctcgctcgcttgatgaggtcgttgagcttgcgcaccgctgccttctgggggaggctctggatgtctctaaagaggtcctgggcctcagcctcgaagagccggcggttgtccgtgttctgcaggggctgcgcccagaaggagccaatgtagacgcgcagtacctcgggcgtgttgatgaccttgcctagggaccacatgagggccccgtagacccgcatcagctgctgcgtgtccacttggtcggccttgttcagcacgacacggatcttgtcgtcctggccccggaaggccttgatggcctctgagaattcatctgagatgtccagcttgtgagcgtcaaagagcaggatgatcctgtccaccctctcggcaaaccactgcaggacctggcagaagtcatagcctgggtggagagaaggacacgtcagtgtagccactgctgcaggagacacgtttaatgggcggctcaggaacagtctcgctctccagcagctgccagggagagagccctgtctccaacctggaggcagtggaggcctggtgacatgaaaatcacgggctggatgaatccgggtgggaaggacctggggagcccttccacaggaggagggaggaaagagaatggggctcatggtcactttgggaattgctgactttcatatctgcgatttcatttagtcctcatgagtgttttatttcacctaatacagaccttttgcttgatggcagaattgatcaatggttttataaaaacacaggccatgggtcaaaagatcttacttctgaaaagtctcacttttctgaaagccccaaatacagaagaaagagaaccagaggccacctggcatcccatgggggtatccagtaagcataacagaagaggcatcgccttcaattaacccaagtttgtagagtgctgaggaggtcaaaggttggcccagccagtgttgtgatcaatatttatctttggactatttataactcaggtatattgtgaatatttttttaacattacgtatcacagccattgtgtaaaatggtctcttgccaatttctttttttaaaatggcctggcccacagcaaattctgtccagcctattctgaccacctccacaaatcatgcagctgcataaacactcttcagcccaaggtcaaggctctcaggcctttccccagggaggcagattcccacgaaaagcaaacaagaggaggccaagcccacaaagttgacttttaatctcagtctgactagttgcagaagcagagtctcaatccagcccagctagtgctgagatgtcacctgcctgacccccatgctaggggtcgtctcccctcttcttttagattttgaaaactttcaaacatacataaacatctgtaagtcatataatgaatgctgatgtacctaccacataattttaacaaatgttgacactttgctttgtttgctatttcagatatgttttaaaaccaagtatcgtttctttagataacaaaataccatacggtggtgagaaggaactagatcttcacttgtcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgccacagacatgggaacagaggaaggttccacgccagtactcggcccactgaacgctgctgcttctgggcatgtgaccaagtgaaagggaaaattgggtttcgcatctcactttccatctcagattaaataccagatgaagaagcaggcccatttaaagaaggctgagccctggagaaagacagcaacatggtattatcagtcattttaggctctttgctggagagggaagttggtaaaaaaacctaccaagaaaatcctgtaagtcctggagcctggcttaacaatttcattctgctgggcctcagtttctatacctgtgagtcagatgatcaaaaaggattctttctagatcttaaattttagctatatagggtggttccaaacagtaagcttctttgaaataaaaagccagattcccaggaaaatcgatttagctcagcgtctgtatagtacagacacgaactagttacagtgccagcctaagatgacccttcagatggctacagtagacccttcagatggctacaggaatactgaatgaacaactctaaatgacacaattatcaaacagtaagtttcattttattacatcccttctactggattcatgtgctatatagcatttgggccaatttgaaggtccttgaatgtttctataggtgtaattagttgccccaaagtttaacttattgtcatccaattccaaacaactctatactgaaagaaactatctgaggaagggttgtggaatgtatgacttccaaggatgcttaagaagtcaccccatctaaccttctgatattattatatattaggatgaacagatccaggaatcccgtgtcacgcacatggaaattgtccattcctcatttttcaagtgggctttgtgtataagtcaggctagaaagtctcatacaatatgtctataaatcagacggagttggcgtggcaaacattacttgcactgaattttcttgaggcaaaatgccaacagactccacccaaatgtgatgaggtcaaacatttataagcaaggctttgaccgtgacaatgcatcttgtcattctgtggttcagaagggcaaaggtaatgtttcttcaggctacagttttctaaagagaaatgttaaaccaacgggatgacaactggggtcataaagggctagaaagcaacttctgacctgaagaccccacccctcgccctgccctgttcctcttttcaaacatcttggcattgcacaagtgtcctgcatgcctgtggacaacagctggcactgcagaccagctctagcaattaagttatcagctaaccagctcctcaagccaaactattactcagagacagttatttctgggcttatgtcacagatggaaagaaagacccagtcagtgggaaccatgggaatccacacggggctccttataaaaaaatgactcactgattttgctaaaagtagcccatgtagttaccaacagtatttcaaaacagtcaaatacctccagaaaaggaaatactttaaaaaggtatacatgaaaagatgctcaaccacactaaccatgaggaatgaaaattagaatcataatgagatggtgggcatgtaaacaggcatgccttctacagtggcatttttggcaccagctaacataataaaaagaccgccgctccttttgattccaaaattccacctctaggaatgcatcttagagttacatctgcacattttttggattagtctctatttcatttatttttttacattgataaagaaaaattgtatatatttatcatgtccaacatgttgttttgaaatatgtatacactgaggctgggtgcagtggctcatgcctgcaatcccaccactttgggaggctgaggcaggtgaatcacttgagcctaggagtttgagaccagcctgggcaacaaggtgaaaccccatctctacaaaaaatgcaaaacattagctgggcatggtggtgcatgcctacagtcccagctactcaggaggctgaggtggcaggatcacttgaacccaggaggtcaaggctgcagtgagctgtgatcgtgccactgcacttcagcctgggtgacggagcttcgagatcctgtctcaaaataaaataaaacataaaataaagtaaaattaaattaaaataaaacaaaattaaatatgcattcaatgtgaaatggctaaattgacagtgcaattagcatatgcattacttcacatacttgttttgttgtggtaagaacacttaaaatctactcagcaatttcttttttttttttttgagacggagtctagctctgtcacccaggctggaatgcagtggcgcaatctcagctcactgcaacctccacctcccaggttcaagtgattctcctgcctcagcctcctgagtagctgggattacaggcgcacgccaccacgcctggctaatttttgtatttttagtagagacagggtttcaccatgttggtcaggctggtctccaactcctgacctcgtgatccgcccacctcagcctcccaaagtgctgggattacaggtgtgagccgccgcgcccagccagcaatttctttttttttttaagctcctcccttttcagcaattttcaagatatatttgcacgttatcgtgccaactgtatacacttgcaccgtacatgctaaactgtgtaaatccactgtggcactgtttgtaacggcaaaagattaggaacagcctgaatgtcacccaccaaaaggatggcacctattaattctggtctatctatatgatggactgcgggaggcagctccgaagtacagacatggacaagctccaagatttactataagtgggaaaatcaagacacagggcagtggagcgaatcccgccagggctccacgtgagtgggcgggtgagctgggagaagccccagggtctgcaggcagggtctgctctgggagaggaactgggggatatgggtggtacagacattcttcactatctttttgtagccttttgtcccaagcacatacacacctacccaccgcagggtgcttcagaaaggtgaaacgctgcatacatggtctgatttgtgctttgcatctcgatttggattccaacaggaggcaattttgagaaagagactaagattacaggtgaatggaggtttcttgaggaaactgcatcagggcatgtgtgagaaatatccctagatacaagaaagaggattatggcaaaaagaattggaggagtgccagaagccgggcccctcagccacacccgggaacactgctcccgggtcattctcttcagcaggtttcccacctccagcccttgtctgcactctcgtggctttccatagctctacggtcaggcccaaatacttcacgcaccctcaccgcccctgctttggatctctggaagagcaaggcccttgtctgagtcccaggactcggccatcctctgccctcccctgggaaatgctgagcgcttggccgagagggccctctgagctgggtccgtctattctgggaccaccccagttctataaaatgaatcatgaccgcccctatcaccagttattaatcatgatccatgttaaatggtttacacatgttatcttcaaaacaaccctgggaaggaaaattccctcactttataaaagcggaaagaggctcacagggccccatgctgggattcaagctcaggtcagcctcctccagggcccacaggagtgtgcctgcatctccccacctccctctgtctttctaaggaaaatacagatgctccctgaaagccttgttattttcagcgtttccccaaccacaggcttgtttggatggtcgagatgcctgcctgcctgccgggcacaggtacatgaaacctgaattcaagccacacgtgtatcctggggaggaccttttgctgtttccctctcactctgagcttcatagataacaggaacggctgatatctatggagcacttaggtatgaacacagatcattcagattctcgtaagatcccactgtacgagagaaagtaccttcccctgttttagagcaggggaaaatgaagctcaaagaggtgaagtaactcgcccaggttgcccagctggcaagggaaagagccagggacagggagaaacgtgcccggccagtgtttctcggcatggattgccactgcctctcttccacctagaatcctgcatttataatctttccctcccaccttctaggctgggggttccccactggtgcacagtgattaggagggagagaagctttaccacctctagcaacagggattgaggctgtgtaacaggaatgtccccataaaaccagggaaggttattaaacgtttcaaagtgtacctgaaaacttaaaaaaattccttctttattttcattaggggttcctaaaaatcctagcttccgaagtaggctaggcgggggtgctcctgcaagcagtgagacacagacagaggacccagcatcaggcctcacgccctccctgtcagacgcccatgaggccgacagggtcacttggtgactcctgcgggacagtcacctctgcttccttccaaagccctgccctggaaggaggctggttagtcacagagcctgccccaccccatcgtctctctcactcaagttctcccctccgttctctgagagggcagccttcaccctcgggcatacagagatgcaggacaaagcccaggttggtttcggtaggttctccaagtttgccagccccttctttcacttgttttggggatggcagggtatgtaggagggacaggctcaggctcaggagtggtggctcagccctaacccagattcctcaaaatggggccccctgtatcagaaccctctggaccctgcccagatgcccctgaaccatgtgccaggaagtttttttttttttttttcaaataaataaatggagttttgctctgttacccaggctggagtacagtggcacaattatagctcactgcagcctcaaactactgggctcaaggttctcttgcctcggcctcccaaggagataggactacgagaacacaccaccacacccaactaatttattttattttttgtggagactgggtctctctatgctgcccaggctggtctggaactcctgccctcaagtgatcctctcgactcagcctcaagttctaggactacaagtgtgagcccctctgcctggctgaagcagcattttaacagctccccaggtgataactgtctgtggaccctggggctcaccgtgctagtcttccgagcatcatttgcagccgtgtggactccagagcaggagggggcagcagggaaaggctggcctagaacatatatgccacatgtatgacagagaaggaaaggacagcaattgcacggccgaaggaaagagaaaaaccagcaaccaaacacgcccagagaactgagtggcaggcccagggctgttcttgcccagtacaggaagacccggacattcctaataattctaggtaatcaacagaagattgaaaaagacaatccttcagtggcttcctggtactctcagagaaaaatctatgcacttccccagggcctacagctcacagcaggtggcgggggggcctcctgatctcatcacccaccacttcctggctgctccctagcctctgccttccccgaatctgccaggtctcacctactctctgcctttgccaatgcagctcctcctgctgaagagctcttcccccaactctctgccaggcaaaccctccattctttacgtccagcctaaatgccacctcctcagagagccctccctgactgcccaccccttgctgtgggacatgtctttgtttcaattgcatttgttttgtgttttggctcctctatctcccctagtatatgcttcatgaaggcagccatgaggtctcactgttgctgtgaaacctaaggcacctggcacctgacacatagtaggtgcttaagaaattgaccagggggcacagcagagtggggtgcacagcagacattcaacataagaaaacctctttcccctttccactatcctaggagtgagaatgcagggtagtgtgtactcttttccaagcaaaattatcatcaaaaattgctaaaggaaaaaaataggagatttgatgttgctgggggaaagcatcaattacattttctcatggggtttgctgccttctccgtgtgtgtgactggcagctgtattttgccctggtttgcatccacgcctcttgtggttaacagcacgcactctggaaccagactgcctggtttcaatcccactcaaccacttattggctattttggtcatcagccaccttaaaatgtagtggcttaaacaataacttctattttctctggaggttctgtgggttgactgggctcagttgggttctcgcttggggtctgtcagaaggtgatagtcagacagtggttggggctggagttacctgacagctcaactgagctggttctgtgatggcccctttactcacatctcagctggaccagccaaggaggctgcctgggcctcttggcctctccttgtgactagcttgggcttccctcacagaatggccgtctcagtcacagtatgacaactactaagagtagttggactttttagatggcattcggctttccacagaatgaacacttgtagagatttaggtggaacctgcagggcttcttatgacctagccttaggaaatcatgaagtatcacttttgcagaattctactgatcaaaagtgagtcagaaggtcaatccagactcatgaagagaagactcccaaggcacgaatgctgggaggcacaggtcttggcgtggtggtgggaggaggcagtatctttgaagacaagctaccatacttgctacatgattgtcagcaaatttcttaagctctctgtgcctcagtcttctcttctataaaatgggataattgctcctacctcacagagcttttgtgaggagcaaatgagttaataatatgtggaaagcacttaacaatgcactatgagagtattagctattattattattactcaaaagagtaaggagcaaatgtttttctctgattaatctctgtatcccaatgtctgagatatcccgtgaaatgttttatatcataaacataaatatgaaatgctctatatgcaaagtaagtgaagtgtccttctccccatcaaataaaattttttgtttttcatctaaaagtcaaggtttcaagtttagataaaaacagtcatttctcacaatcaataatgcatttgatgtattaacaaaaactcaaactagctgccggggctggcgaacgctgttgtgagtcacagtggcgatatgctcacatcagggccggaagcagtaacacttgtggtgtggaatttcccgtggcaccagcggaaaaggagtctggatgcgtttgtcaaaacttccccgaaacaaaaagaaatcaggatttcctgctagaggcccaagtggctagtgatgtccaggacctcacaacccaacctcagactggccttagccctggctggaaaacaggatctgccaacaaatcatcagggctgggccccagcctccagggatggacacttttctgtcactgccaaatccagacaaagctcagagtcaggtcactgaatgcaaactctaaataaaaaaatggcttcatgatccacgcctgtggctgcatgttctattctacagaattctccaccacgtcctcccatacctcctacccctcagtattccatgtggccttcaggacaaattcgagtctcctgccacatgcgcccacctgccatggacccatgttccagccacatgcacagcttccgttcctccaagggccctgagctcacatatctctctctgttctttcatacactctttctgttgtctagaagagatatcaacaggaagggcagccacagttctctctccctcgactcggtgctaggcagaggctgtggtaagagtgtcatgtcttcgtctcagtttgtctgcacgctggcctacagcgccctgccttggctggctagagagctcacccatctctccagccaggctctgatcaacagcctttcagaaggatagacacatagagcaatggaagggaactgagggttcttggtcttttaggaaaaaagactcatttcttttttgcatatgtgtgtgttttcctctcaaatccttcttgttaccaaagcctgagaggggaagtcattcttatctggacatctctaagtgttctctctcctttcccgagcaagcttcaaaatccggtcttttgtcttcaaagttcaaaagtggatgcatttgtacttccctgattgtggtctgctggtgcctttttcatttttttctgcacccctcttagtcacagcttggatgtccaggccccatttcctagctctgtcgattcttttgagatatgggttgagtaaaccttatccgaaaaggttgggactggaagtgttttggatttcagattttctgattggggaatatctgcacatacatatataatgagagatcttgggaaagggacccaagcctaaacactaaattcatttatgtttcatagacaccatacacagatggcctaaaggtaattttacagaacatttaaaataattttgtgcatgaaacaaagtttggatcgtgccccgtcacatgaggtcaggtgtagaattttccacttgtggcatcacgtcaaaaagttttggattttggaggattttggattttgaattttcagtttcaagatgttcaacctgtattgtgtttgagcaccttagctgtgttggcaggcccttgaaacagcctgttcctgtttatatcactacccaggcgcctttttgattcttgagggctttccttaacatctccttaacattgcctaggaggacttaaagatgtttgtatatagacgttaaaatggtaatcagtgattctgaagtttctgttattgcccgtcatgttacctgaagtgcagttagatcctcccggcttcatgtactattactgtccactgcttttaccagcagggcattttctgtccttttatttttcattgtcttcccagttctattcattggtttataatgaataggctgggattaagaggcgagagcttaaacatcaggaaaagacactctcgaattttcatttgacagctgttgttcctgagagaataagtcgatctgttagaaaatttagatagagctttttccttctagagttatttaaatttttaaaagggagaagctgtactatttttattaccaaaatcaagtctattgaaggctacgcaaaacctcatattctcaagaaaccataggaataatctgtggttaaaacagcaccttgaaaatgccaaatgctaaatagattgataagaataccagttgctacattataatttttcaaaggatgttatgattggagtcagaatccggaggtttgtactaagtagctgggaacacacttgtgttcatgctaactctagaaatatatcctagattatgtttaggttcagcatggactcaatagtattctaggaaacagtatttcagcggccagcatgataagaggtcgagtgggaaggaaaatgctatgcgtgtggataaaggtgctctttcttctcatcgcagagtcaaacacctggctgctatcaccaaggacaaaggatgttctgaagagtgaaccaactcagatttacccacacacttcaagaaagcaatttagaaaaccgcaggaatccaaacattctttcattggctactaaaatacaagaaaagaaatcaagaaaagtttgtaggacttttaggaagctattacttgatcagaatattattattataaatatatcagaacacttttatccttgcttgatgggaattcaacacttcacgtcagccaggaaagctacaggttagtaactaaactaacctagtctgttgtccctaaagattttctgccaatggccaggcatggtggctcacacctgtaatcccagcactttgggaggccgaggcgggtggatcacacctgaggtcaggagtttgagaccagtttggccaatatggttaccatactgattatcattttaacatttatatacaaacatctttaagtcttcctagacaatgttaaggaaatgttaaggaaagccctcaagaatcaatatggtgaaaccccgtcacttctaaaaatacaaaaattagccaggcatggtggcaggcacctgtagtcccagctactcaggaggctgaggcaggagaatcacttgatcctgcgaggcagaggctgcagtgagcactccattgcactccagctttggtgacacagcaagactccgtctcaaaaaaaaaaaaaaaaaaaaagattttctgctaaccataattgaactaaggaaaacttgaggggtaaggagtttccatacggagtagtatactaaaaattgctccaaaatcaattgccctcatgggtttcatttatacggctcctaaacaggagatttagatgacgtttactcccctggaatgctatgtatttttttttttaaataaatagggatgaggtctcactatgttggccaagctggtctctaactcctgaactcaagggatcctcgtgcctcggcctcccaaagggctgggattataggcgtgagccaccgcgcccagccactcagcttttgagggttaatcatcaaccgcacaaaggggaaaggaggagcagtggagggcagtacacaagcggccacctttcctccttcccaggcacaatgcccataagggaggcaaagacccgccaataaagtcagtgggggatgctttaaacatcttgtggggtcacagtttgtacccagtctattatcccatgttgacattaattcttggcaaaggtggggctgtggtcttatgaagctggtcttacgaagctgggtgtaggtgtgagtatacgtgagaacgtggcactgtttgcaatcgtttgagctgaagctgctttacaacagtatgcattctttggggttagtgtgttgaaaatgtcagctgagtgacttccaccaccagctgcgcccctaacaccgtgtggcaccgggcttgggaaccacagctgtggcccgtcgtgctgtcatcgcttgtggctctgggtccttccccacctgttgctgtgtccgtcggtgtggcagggaccgccgactggctggaacatatatgctatttctgtgcataggatgtgagtaagtacatgccatagtaagtcagaccaggatatgagtcagatcatattataaagtgatacaaagaactgatcttcaaagcattctggaagcattaatccacgtgtcaacactattgtaagggagctacagtttgaaagacacgattactaagcaaaggagagacgctgcaagactcaggtgaacagaactggctaaaggcctaccaatgaaaacaaatgcatatggtgggagccaaaatccggaggccttaaaatttagaggtaaaaagaaagagttagcaggaccacatatttctccagcatattcagtcagaaatggagaagcagtgaaacacgggcagctcagaatagctgtggaacatgggcctgctttattatccatactatctgcagagcaacctttctggggctaaattaatggtcctcaactgactcttaaaaaaaaaaattgattggcactgaggtgtaaagacacacataaaaagacgaccatccacagcactatttgtaagcataaaaactgattaaccatcatgatgtccacaaatcagcaaaatgaactatattatgtcactttcatggaacccaagtagctattaaaaggaatgaaataatctgaatatactggcatggaatgatgtccaaggtagactgttatgaagaaaaatcaaggtgtagaaaatgtgcatggtaatcccatttctattagaaatgtgtttgcatatgcgcaggaaaaagtctctaagaagtgagagaaaaccattaataattgttaaatgtgacagtgagttttttttaaattcttattcattgactgaatcctttgccataaacatctatacttttataatagaaaataaagccaacaagatatttatgaatagcattaacctgttttttggtgtttttttttttgtttttttttcataattgcaaggttcttggaggcccgggaaaggtgaccttaatggcattccatagctggcaagtccctgactgaaacagtgaaggcacagcaggcaccctgggaggcctcggctcagcatagccccgagctctctgcgggaccacggagcagcagagatggcattcccaaaatgccaagagaaaggagggcttattggcctcggaatccctttcttgacccctgtcacgggaccctcactggcctatgtaactgcacttctgctttgtgagctgtggggtgttcactgccttgtcataacctgcgaccgtgaccccacacaggcttctgctcaaccctggcatgcccagacttctcagcacggtgctaccgacttgctgttcaaggggttgtgaagagttctcagccagaagtgatggcagcgatgcatctgctccatctcctccctcccagcaacccgcctttgtttcaagggccagggcaaggaaaagacttgagctgcctctggacctgtgatggcaggaacccatcctgaccctcccgatcaggcatttcctctccgtaagtcaactctgtcctctggtctgcccctgatgcccccttcctccaggacggagggagatagcaggcccaccggttttttgtttttttttttttttttgagacggagtttcgctcttttgcccacaggctagagtgccatggcatgatctcagctctccgcaacctccgcctcccaggttcagctctcgtgcctcagccttccgagtagctgggactataggtgcccaccaccatgcccagctaatttttgtatttttagtagagatggggtttcaccatgttggccaggctcttctcgaactcctgacctcagctgatccacctgcctcggcctcctaaagtgctgggattacaggcgtgagccactctacccagcagacccatctgttttgactacaaagcacaggcctagaagcagctattgcctcagccttgtcttgtgaaggctggagaaacttatgcttcggcacaagcattttctatccttcacagatcccctctgaatgcttcataatctctccctaccccacagcttcccttaggtaattcctactccttcagatcctagttccaatgctgcttcctccaggagcctctcccaacacccccgaggccaagccaggtcccctcacacctcgatacctcccattgtttaccccactcctcatcttcatttactcatgtgtaacttgacaaatgtctttctcacagaatataagcctctggagggggcagagtctttgatgctatgaactcctggttgacacttggggccccttcagctgcccaacagctgtcctggaggacggatagaataatatagggacagaaatcctctgctcacagcagagagggcctcagccagcacttggtggggaggggcagggacaggcactgacctcggctgatgcgctgcttctccccagaaaggatgccggggctgtcgatgacgctgatgctcttcaggacctgattggggagctgtgagcacatgaatctggaagagacggatcaaaggaggggtcagaaactgggcatcacagagtgctccaaccatggggcttcttggcctctctgggcttactgacatctgtaaagtgggggcctgaaggagactgacagaaactgaggatgcctaatgaagttgtttgtgaagtaggagcttggaggagattgatagcacctccatccagccacagagaacagatgctggcccatgggacaggtatgagaggtgcacaagcacctgctgccatctgccacctgatgcctttctgttcattttgattttagctaacatttattgaacatgcaggtatcttacaaatatcctctcatttgatcctcatattgacctcatgaggtgaaggaattatgcttaacataagagaggttaagtaatgctcagggtcactcagagcggtgccttaaaccaaggtcagcctgcctccaaagccatgggcctcacctctcctggctccatgctggcccctgcccaagcatcctgggcctctccccctgggaatcccatgccttcttcaggatgcactggcccactgggctggagagccccaagctccctgcctatttcctagcatgaaagctgaagggactggggcctgtttccccatctgatgccccaggaacttagcatccagcccagtgtcccctatggctttagggccagggaggggcaggcacctgtgacacccaacatcctccaggtgcttaggagtctaggggagctggagagtaggtgaggggaccaggttggggaaggccctggctgagcatctttaggcccctcttgttcctcatttgcctgataccatctcctcctcctgatcctggtccctttccctgtagtcactgcccttgtatccactccacggaagcagagtgcggaggaaaaatctagcctgtgggtcagcagacctgggttcaagttctgcccagcgtttcctgataatctgctatgggactctgggtaagggcctccctgctctgggtcttgggttcctcacatgaaaatggtggcttcccgacagggtctggcgatgtccttttagctttcagactgagtaactccaaaagtgatggcaggaagtgctttgttacttccaccctgggcaccagggtctgggatggacctttgtgaggcactgtgcatgtttaaggcagaaagtgtagaatgcctctccttttcctttactatggatggctgacatctgtgtctgtgtgggcagaaagctaaaagctcaattcttccgtacgatggaagtggtggggattactcacaaagtaaaaatgctgggaatgcaggacagggaggcctggccagcctccacagtgcacatgtggacaccacagccctgggtatgagcggccgttactgacatttcaaaatcactttctctgaaggggcttgggatacgatttttcacacagtctttcctacattttcaaatcggcccaggaagatatagaaaaagacattaggatccttttgcaggtggaaaagttgaagcacaaagcagttatgacattctgaggccatgctgctaatgcacggctggttgcagactgcaacctactgtttctgatgtcagtggggtggaatttaacccacaaagttaaaaacctcataacattaaaagtaaagggtcaagttagtggaagagaagcccccaatttccacctgtctgcagacacttgtgcacagtcccctcctgtaccccaacctttaaataaaccctactacccaacacggggagaggtttgtgggaataaagcacatgaggctcaccaagcattctttgtaagttcacagaaaaaaccccaccatgccattattcaattctctagaattggggtgggaacagggctctgggcacatccgtggtgaacctcgtttcttgtcaggaatgattgtctctcagtgccgtcccattctttccatcagatggcccgagacatctggcggagctgaacatatcacacctacgtgaaacaattttctgcaaaccattcccgtggacaggctgatcttttccccaaaccacaagctcacactcaatatccatttttccaaaacagccaccccctagattctcaggtgaggctaacagagggattcaaaatttgcacactgttcactccctgtgtataaagtgacagcctttccacagctcccaggcctcctgacatgacagcagaggccaggcacgggagccacagagcaagccaccgtgagatgtgctgacgtcaccacatggcatacaagcgggcaaagcgaggagcccaggatggctgaaaaagagaggatgaggagcagcaggtggaggcggagggagagctttggctggggcacctcaagagtgggcagctggggttttgggtgcacagctggactctgctccctgaaagacagtgtccaggggtgaggggcaggcaagagaacagaaaggagcattgagaccctgtggtgccacgctcatgctgcgaggtgacaactgcatatgaatgcattcgtacgaagttatgctgggatcagaaaaaatcctaatggtgttctagcaatcatgcctcatgcttcttctctgagaaagggaggcgcacggcaaacgtacttgctgtgtgtataacagcagtgcagtggtagtcgtagcccagtagtgaagaacctgggctctgcagtcagcactgccaagttcatgtcccgaccccatcaactcacagccgtgggactgggcaaggtatgtcgtgtgactcctctgcgcccagtctcctcctttataagcagaggttcacagccctacctgtaaggttgtggtgagcctggagttaatgtgcacggaaagtgctttgaacggtgcctgacacccagtaagggggccctggccggcccagcttattgaaatgcttccaagcacagatttgctgtcccaagatggatttcctactccttcctggggagattaacacaaggaggatctgtgccttgccctctacatttcacgtaaaatatgcagacacatgctggttcaacccaggagcctcacatggccctcacccgaggatgacctgataaatgttgtcttctgaagtaagagaagaagacggagcaactgaagatcctaggctgccccctcaactccatatcctctccacgtctaaggaagggccaggggtagcagagatgggggataaagtaatggtccaggctatgaggtctcaggcaagctgctaggagtcctgccacacagtaaaaggagagagcaaagccaggcaccatgactctccctgtaatcccagcactttggaggctgagtggggacgatctcttgaacccaggagttcaagaccagcctgggcaccataatgagacttcgtctctacaaaaaataaaattagccgggcatggtggcatgcgcttgtagtcccagctactcaggagcctgaggtgggaggatggcttgagcccaggaggtcggagctgcagtgagctttgatggtgccagtgcactacagcctgtgcaacagagtgagaccctgtctcagataaatacatacatacatacatatctacagaaggagggggcaaggagattacttaaaatttcccccaaacactaaaattccaattaaatgatcagcattttaaaaactagacttttagaagaaccagacagtaccttaatactgattttgatttctcaacaaaacagtaatatctgtagcagttataataataataaaatagcacaaacatttcctcacctcttactgggtgtcaggcacagtttgaagtactttccatgcacattaactccagccttactgcagccttacaggtagggctgtgagcctctgcatttagaggaggagactgggcacagagcagacacatgccataacatgctgagaagtgatggagctgggacatgaacttggcagtgctgactgcagagcccaggttcttcactcctgggctactatcaccatggcacacactggaaccactgctgtgtggcatatcatgtgcagggcaacatcctaaaacaaaggggtgacgtgccacagccctggaacttgcccctaagaggcttccttgtgtggtttgctctctacctagtggtgtggagtgtctgtcagggtggggaacaggaggtaggagatttaggctccagacgtctcccttactcattctgagaccttgaccttgcacaggtctctaaacctctctgagcaattctaccaggcctgcggacttccaggtttgccattaggttcaaataaacctaagcttacagcggagagagtatagaattgtttcaaagtacttcttttcaccccagcccactttattgatgagggtaaaaccagagagataatacaacttcctaaatttgcacagtaaatagaacacaacccacaaaaaagactttgacaactgaactgtaataattcttattatatggtcctaccacaaatggctaatcttatcttccagtgcctaggaagaactaggaactgaatttcacatccagattacagcaaagcccctggttgccctattagattgaaactaattaccacttttaaaggttaaagattatttaagactgccaatttcatatggttcaacctaaatatgtacttttataaatcccctcctgactgccacaggggaaagcccagtgcaatggcccagccaggaaggtctgcctgaccccagggagaaaggcatttctggaatgtcaggaccagaaatgtacaggcagctgctagtcaagaacaatggtttaggccaggcgcggtggctcacgcctgtaatcccagcactttgggaggccaaggcaggtggatcacgaggtcaggagttcaaatcagcctggccaacacagtgaaaccctgtctgtactaaaaatacaaaaattagccgggtgtggtggtgagcacctgtaatcacagctactcgggaggctgaggcagagaattgcttgaacccgggaggcagagtttgcagtgagccaagattgcgccactgcactccagcataggtgatggagcaagactccgcctccaaaaaaaaaaccacgatggtttagtgaccagggaactaccacccagggaaccaccacaaatcttttttattattgttatttttttagggacaaggtctctcgctatgttgcccaggttggtctcaaactcctgagctcaagtgatcggcctgcctcggcctcccaaagtgctgggattataggtgtgagccaccgtggctggccaacaaatcttgaggttaaagaataatggggaaagcttcagcaagtttattatagataaatgaaccacaatacacatgcacaagacaacccagttattccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttcagaatgtctcactaaagccatttccatagacctctgtgtgttctaaactccttttattgttcaagtatggaatttctctaatataaacctttttaggaatttatcttcatttctcagaaatgcaccatagaccccttgtcgctccttagaagccagcctgggaggctgtgactcgggctttgctggtttgcttaatggtggagggtgttgtccccctccaggtatcacctggtacttaactcttttaaagatgcccctgggggcagatgcccaagccagcactccttaaggagaaggccaggtaataacgatctgtcacagggagattctggtgtggctgcttgggagagaaagttctccgcagaaaacaagcaattttctttactaggtgttacattttgacctagttcccagagaagtatgctatgtgaaaagaggtttgcctctagtactaaccctgtgctgttcccagacggaagctataattatgtacacatatttgaacgccctaactaattgactctttcttaaataactgctgtgtgatgcagtggcactgtcctgtggatactacttaatgaggctgtttactcttaagtagctatgagtttacatgaggcatgtcccttacacgtgagcctgacacacacttggctagaaggacagaaactcctcttggccgatgctgagcagaggcatagggtgtgggacaggggagaaggggaacactggattccaatcccctctctgcctcttcctgatggcctctccctgagcaagtcatgtctttgctttcggccttctcatttgtagattggcaacagtattgtctgtgttatcaacgccaaaagaataatgtacatgaaattacgtaagtgatgacttgggacataatcaccgtcatcttcatcatcattactggagggctacattaggaacagccttactaaccctaaccctaaccctaaccctaaccctaagagttaaatagggggcactgggcagtgattcccagtccaaacatcatactattggtcagctggcctgggttccagtcccagcactgatctcactggtggagtgacccccagaaattaaagtaacctctttatgccttgattcctccccctccattgaggataacagtagcatcatgtcacaggggttctgtgaggatttaaagctaatacacaagtctagaacagaatctgacacataaatgccatataattatttgctattatttttctatatgttattctgaattcaactgacacttgcttttattataaggcatggattattttcagcaagttttaaattctgagacaagagctttgccattcaaaatcgttcctaaaaatttcttttctgtactcatctgtcatgtgcttgggatttgagaagaaaaaaacattttttttttttgttaggaaagtaaatcatttgccaaaataaagcaagccaataaccactcttcctggtttctcccttgtgaattcagacttcacaaagtgggaatttgaaaaaactggcagcttatttcgttaagcctttgttgggcaaaaagagccccagacaaagggcagtggcaatgaaaccagaggaccccagggaagccttccacagagacagatcctgtgccttgaactttctggggcctcctgttctggtctacttcccctccaccctgggccactctgtcctgagagatctggagagttgaccctctggggttctcccgcccagggcttaaccccctctcccacaatgagacactctggtgccaaccaagtcagctctggagttgaagagtaaactcctcctagaaaagtcagccctgcaggttggaaaaaaatcacctggacagtgttcctatcaccatcagtaataagatggaactcctctgggactccttccacatcacctgcaggtttctgttcatcccactgccaagttccctggttgctttctttgatttgcaataggatcatcaaaaagcccctaatggagaattcagctccccggagagttccatcttccacagaaggcacctgcggaggggcctgggtggccctcagccgagccagtgcacagcatccagcacatcattcattccccaggccacatgaatggtgcccctggagctgcgcgatgaggcgcttcggcctttgggaggacagcagccggctgggaggatccgttcctatttttaaaaacttctagaaaggagatgtggactgtcagctctaatgctacttcctctccctaaagaggctcggatgaccctccctagctctgtgcctcctacaacccactcctccaaatcagccacacgaaagctagacccaggaaagagggaaatagaggggtgggagagggatgataggaaacaagaaaaaagcattacacaaacgcaaggggtagcaaataggaggtgcaggagggaggaaggaaggcagatccagtgggaaagggcagagttgtagccaggggtaccagctggcctgtcttccccaggccagcagccctcagttccactgggaactctaatgaaaggttatgggaggagtacaaataaaacacatctccaagtgaggcagaacctcagtgaccccacaactttacatctataaaatagtgaccacgtaggctgggtgtggtggctcacatctgtaatcccagcactctgggaaggcgaggcgggtggatcacctgaggtcaggagtttgagaccagcttggccaacatggtgaaaccctgtctgtactaaaaatacgaaaattagctgggtgtggtggtgggtgcctgtaatcccagctacttgggaggctgaggcaggagaattgcttgaacctgggaggcggaggttgcagtgagcggagatcatgccactgcactccagcctgggagacagaatgagactctatcttcccccccgcaaaaaaaaaaaaaaaaaaaaaaacgaccacgtaagaaaatcagcttttcatgtttttcactctgtttccctggccctgctctgatgaataaggaaacagctcaaagctgggagtgagaagcaaaagggacagccagggaggtgaggggtcctgttctggagtcagtgggtaaaatccgagtgtccggtgaaggttaggggtcctctgggctaagctctctgactgcagaagcccagcgcaccatgcctgagaggtgtctgtctaaccagtgcttaacattgccagtgacgaggagctcactgcctcatgaggcagcctaatccatttctgtgcagctcaaattattagaaatttgttccttatactgtaagcatttttattttttaacttttaaaattttttgcagagacagggtcttacttcgttgtccaagctggtctcaaactcctggcttcgaacaatccttttgcctcagcctcccaaagtgctggattacaagcacgagccacacacctggccctgtgcagccttataatgtccagttctgggccttagctctgccctctcaagttacccagaataggcataaatgattatttcctatgatagtctttcaaatatcttaatatgataaacatattttgtatgacttctagagcagagattctttgttcttctgtttttgaacctttatatgtaactggcagtaattcaaagaaaaggtttaaacagcctgaccgaagatggcagcttgctggtccttaccgattcaggaaagcgtttccaaagcgactgagctttctaaacggctttttggggtccacgactaaagcattccctggggtgctgccctcagtctctccatacatcacggcgatgaaggagtctgtggtgggctccggaccaatcctcatgcctgggaaatcctgctccagtaggtatctgggagagggaagaagaagagaaagcttagcatcttatcacaaagtaagaggccagaaagctgcctgggattaccaatttttttacataatcatttaaaaacgtagaaacataacccccaagaaaagcacgcaatcctcctctgcatttctgttgatgcaacagacgctaccccaagggaagtgtaccgtgctggctcctgggcatcctggaagctctgctcaggctcagctcccttaggggagcctccctgacctgcatgtggggacacctcttttgtggtccctgggcaccctgtgcctgctgccagcgtggtgctcagcatgtgtactacaattacttgtttatgggccctgcaaggtgtctgagctgatgagggcagactcatgtcccaaccatgccaggaggatgatcttcgtcttataagccttgaaggggctcaagggaaaaaacctgcacagccttctgcagctccccattcctgcaactaacaatctatttggtcctaaactacttctttgtttctaaaaagttttgactgattctaatgtaagcccacaatctgtgactatttccagggaaagagagaaagtgctgaattctatcaaatgccaaatacaatttttccatctttaaaagaatgagaaattaagccaccatttagacctatgttttctatgtaaataaaactgaaaaaaaatttttttttttgagactgggtcttgctctgttgcccaggctggctggagtgcagtggtgcaatctcggctcactgctgcctcgacctcctgggctccaacaatcctcctgcctcagcctcccaagtagctgggactacagacacatgccaccatgcctagctaattttttgtagaaacagggtttcaccatgttgcccaggctggtcttgaatgcctgggctcaagctatcccctcaccttggcctcccaaagtactgggattacaggcatgagccaccgcaactggcctaaaactgaaattgtttagcaaccttaacgggctatattctaaacctttaattgatgtcattgctagttttcacttcatccaaagtttctacgtttctgtgaagttgtggcaccccagaatagatacaccattaaaatatgtctcctaaatttacagtaaatctgatgatatcttttatctctaaatttagagaaaaaaatctgctaatagcacacggcatttactgagtgcttgctatattcctgatatggcgctgagccttctatattgtttcacctcatgctctgaggtggatgatgacattaccctcgttttatttacaggtgggaaaactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtcctctggctaccctgacaacaagggccagctctccctactctccctggagtaaagctgggctcaggaggtgctaccgtttcaaaatgtgttcagctttaatttttaaaatatcttcaagagtttctccatcaaaacctctgtatccctaatagcctagaaatgttcgtgttgatcaattcttacacattccacacaaatctgagaaatgctggtaaaagttactgtgagggatgcccactctgtgaaactccagcctctatggagtggatgcagagcgtgtggactccatatacccatgggaatgtggaatttaggttttacagcccctctgggatctcaagggtgaagacattcagcagcgaggctggaattcaaagccagatcacactcttgcctccactcacgtccagtttgatttttacgccctgtggcctggatggggctatgtctggaggctggtatgactgagggaggagagactgctggggagggaggggcttgggagaacagcagccagtgtcgcccagctccccgcagcacacacagttcgcaattcacgaaaatgtgaggtgcgggagtgggtttgaagcttgacaggcactttgctccagaatcagtgctaatagcaacggtgggctggccaagacggcctacaaaaggtcacacacactgattaaagggatgaaccagacgagaactgcagcgtgtgctttttggggaagagctcggtgtggagctccaccttgggtggctcgcggcaacacggccccttctcggcaccttcaccaagcctggccaggaggaggcccttcagattccgggccagggaggtgagcatacggatatcgtagttaagcagtgagtcccccagctggacaatcactcacacagcacaggtgttgaagtcagacatcactgtcgaggagtgcctgaattactttctgatgtttcattcctgtacaagtacagcaaatcccactacttttgaaataacaggggtttcaaggaaaaatataaatgaaaaaattgtttaaagaagagcagatgtttcctacattcaagtttatattgcaatcgaagccagagttttctaagtagcgaccctactggacagacctttaacaataaatcatttttaaagtgtgcttcaagtgtgaaataatttgaagtcaaaggtgtccccctttgactgtgaccttggtaaatcaatctctggatctcagacacagaggaagaactagaattaggaagaattactgtattataaagcttgcttgcattatcaatttgtttggtgatactttcacagataatacaaagttaacattcagtgttcaatttcaccatcaaagaaataccagtaaagacagagcacattaacaaatttttgaaaactcggaatcatcaatgctggcaagggtcctgtgagataaacacccttatatatgttggtgggggaataagttggtctaacttcactaaaaagcaatttgacaccatgtgttagaagcctttaaaatgggggtcttgctgggagcggtggctcgtgcctgtaattccagcattttgggaggccgcagtgggaggatcgcttggcctaggagttcgagactagcctgggcaacatggagaaaccccgtctctacaaaacatacaaaaattagccaggtgtggtggcgtgcatctgtagtcccagctacttaagaggctggggtgggatggtcgcttgagcccagggaggttgaagctgcagtgagctgtgaccatgtcactgcactccagcctaggtgacagagtgagaccctgtctctaaataaataaagaaaaaataaactcaaatggggattttgcggagttgacctctaacagctcgtgctggtgttatttgagggcctgtttcctctcctctcttgggctgtcatttcctgcagggcatggtctatatactcagtactttagaaacctggagtctggtaggaatgatttgagtcagcctcttatctttacaagcgacaagactgagggttagtgcaggaacatggcttgttgctggtcaaactcacagggtggccatgcaggatccagaacctgcagcccctttctcctggccccagacttctgctcttacaccaggcacagcaccatcaccctggggtcctacactgcccccagctccctggtgctctaagcaggacctggcagatccctgactttacatatgacactctaagctgattgccctgaagaagatttttcactgggggactgcagaaactcagattcatctgttacactgctgggtaaacaggtacatgtcagtgcagtgagggaactcggaacaaccaagacaccaagtatctgacatggaaaaagggagaatgaagtgatggatccacacacagcaagctggaagggaagagtctgagctgatgctgaggtgcaatgtgcataaatgggtcaatcacacagccacacgggatagacagcctgatcaactgtgttagacatttctcacggtgggagtgcctcagaggctttcccaaagctacgagtttcagggactctagtattatctgcaataacaacaattcaaaggaacaagaggacacaggaagaccaccgtgattcagagctgattagcccctccacaggcatcctgtgctttggagacttgatttttgtccttggctccactttgctccccctttcctgtgttctcggagaggcctgccaattccagcaatgattgctccaaggttctcgagccaagccagccacataaaaaggtatggacatttggattccaagcagctgggcggaagggatggtgggatggatgggagacctgacatccccttgtcctggtccgatgaggtccccagttcagactcatccaagtggctctggggtaccccggttgccagcattcagcccaagctcacagagctactttgatgcaagagtatatatggatggtgtcttctttttttcattgcttaggctagaattttttttttcacttcatagaagtgaatgtcatttatgacaaggggaagaaaaaaaactctcaagatattgaaaacagagatactctcaatatgtccaagcaccatcttctcaacgatgagcttaagaatgaataaaaaccaaacaaatctaagtggcacattattcaaacaaatgctggagtagtgggcaaagcattacactttaaataaatatacctaacgcttgaggactcgttatgtgctaaagtctttacatgaatagtctcatttcatcctaactaccttatgggcaggtactatttctatccctattttacagatgaggaaactaaggctcaaatgggttaagcggtttattaagatgaaggatttcttactagtcttatgaggacaccacccaccctaaatcagagcctgagaggccgacgggttccactgggaatgtttacaggaacgtgtcctgtgaatcataacaaatacacaaatgtaagattttaaaaataatacggcacatatattttgagtgttgtatgagcattatttttaaattatcaagccaaatctaaagaaatggtttgtgtgggctgggcgtggtggctcacgcctgtaatcccagcactttgggaggccgaggtgggcggatcacgaggtcaggagatcgagaccatcctggctaacacggtgaaaccccgtctctactaaaaatacaaaaataaaattagccaggcatggtggcgggcgcctgtagtcccagctactcgggaggctgaggcaggagaatggcgtgaacccgggaggctgagcttgcagtgagccgagatcgtgccactgcactccagcctgggtgacagagcaagactttgtctcaaaaaaaaaaaaaaaaaaaaaaaaaaaagaaatggtttgtgtgatgataaacgagatcttaaaatatgttcgtgcataccttggcatctgtgcatggagtttgggggttcaattcattgctattgcctgaaacatttttaaaataagttttggaaagtttcatgtaatatatttttcttcagaatacttacttgatccactatttcactaggagagggatgaaaaggaagagttactacttctactctgatttgatttgagcctggaaagatgttttaagagcagtttctggccgggcacggtggctcacacctgtaatcccagcactttgagaggctgaggtggatggatcatgtgaggtcaggagttcaaggccaccctgtggcaaacacggtgaaaccccgtctctactaaaagcacaaaaattagccgggcgtggtggtgcgcacctgtaatcccagctactcgggaggatgaggcaggagaattgcttgaacctgggaggcggaggttgcagtgagccaaaattgcaccactgcattccagactgggtgagactccacctcaaaaaaaaaaaaaaaaaagcagtttctattgtttaatctatccttgtgtttcacaccaggaaaagtaagtgggagaatcaagcatttattacttccaaagtcttacaagataggccaagatatataaatatttcctagcaaaacagtatgacctgcactatcactgcttctagatactaacaaatgacaggttactctgaagccgtactgtacagtttataatgcatttcacacattcagcttatttcatcctcactgccatgggagcaggtatttttattcctagtttatagaggagaaaactgcttatgccaagttaaatagcttacaggagaccacattaatactgggtaatgactacttttaacattttgatgtatttccatcccatcatttttcagtaaatgtaattttcctttataaaattgagataaaagttaaacaattttgcatcttgatttttcaccattagtctttcctcataccattaaaaattctttgaaaacatgatttttaatggctgcatactattctaagttgaatatgtatcaatttattttgtcatttcctgttaggcatttaaatagctttctattttttgctgttataaataatgctgagataaacatccctgaacaaacatctcatctacttaaaaaagtctcctttgaattactgaaaaactaagttaggctgatcttcacttacatttttttttttttttttttttgagatggagtcttgctttgtcacccaggctggagtgcagtggcatgatctcagctcactgcaacctctgcctcctgggttcaagtgattctcctgcctcagcctcccaagtagctgggattacaggcgtccgccacacactgggctaatttttgtatttttagtagagacggggttttaccatgttgtccaggctggtctcaaactcctgacctcaggtgatctgcccgcctcagccttccaaaatgctgggattagaggtgtgagccaccgcgccagcctcacttacattttaaatgtgaaaactaagttttattttcatttttcctttagttaaatcattgacatgttatcaccaggactgtttgttcagatgatgtcacctttgaaactgctgtgcctactaagggaatggacattaggtcattgaaccaataaactggaatttgctgggtaaaacttttcgtatctcaggctatttttccagctatggatgggatttatactcctcagggctgagatgtgcttgaaagcacactgctgtctacccactgccattacctgtaagttgctccactccaccttccatgctgttttgggaggagggtgaaagaaagggaggggaatttcactagaatcaaatcagtttcttacagttctatttgttcttccagtctttcagtcatgcaatgactatttattgagtgtttttgatgttgtaacttgtaatttaggagtatgacaacagactttaggttgtaaactctttgatctgggagtactgtaaatcgtcatgaggaggttatggaacacagcatatcccaaagttacttgactatggaacccttttattttctttgaacacttacgaatgatctcccacaactgcattccacagaacataggttaaaggaaaaggctaaaaggcatctaacaaactccatatccattttgtttttttctccaaatagaatcatttaaatgaaatccttttaaaactagtaatagataatttcttaatgcaattaatttatagataagaagccaccagctgacataatctcttaaggtgaaataacataggcaataccattaagattagaagcttgatatgaatgcctacttcctggtattatgaaatatggaacagaaggggagacaaagtaatcatgaaggtaactgatacagttatctatctagaaaacctaagagaatctactgacaagctgtcagaataacttcttgagtcaaatgaccagatataaaacaaaaatgtacaactcagtagcttccttacatatcagcaataccctgccaaaaaaaataagagaaataaaaagcccattcataagagcaacagggcataaaatacctaatacattaataagagctccataggacctgtatgagtaaatcaatcacttttccaagaaggtctgcgttaaagcaatggtgagctgctgcttgggaagagcaaatacaaaaatgtaacttagagacagaatgcagttccaggacaaatggatcccagtgggatttttttttgtttgttttgaagaacctaactaagaaagttcttctcaaagaatgacagaaaatgagaattgatagcatttgaaaaataaagagtaatgcacgcagaagagtcttgagctaaaattattaaaaagtatttcaaagtgacaatatttaagatggtatggtgttggcataagaatttacaaacagaataacacgagacaaaggtcctaacagactcaatatagtatttaataacttagcgtatgaggaagcctcatgtgacagcagaaaaaggtagatttaataatagtgttagaaaatgacaaaagacaaaaaaaaaaaaacccacaacaatataattgagacagattttacttccaggtgggttaaaaagttaaatatttaaaaagtaatcctattttaaaaagagcgcccggccagccgccccgtccgggagggaggcggggggcagcccccacccggccgccgccccgtctgggaggtggggggcgcctctgcccagccaccctgtctgggaagtgaggagcccctctgcccggccgccaccctgtctgggaggtgtacccaacagctcattgagaacgggccatgatgaggatggcggttttgtcgaatagaaaagggggaaatgtggggaaaagaaagagagatcagattgttactgtgtctgtgtagaaagaagtagacataggagactgcattttgttctgtactaagaaaaattcttctgccttgggatgctgttaatctatgactttacccccaaccccgtgctctctgaaacatgtgctgtgtccactcagggttaaatggattaagggcagtgcaagatgtgctttgttaaacagatgcctgaaggcagcatactccttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccccctcggagaaacacccaagaatgatcaataaatactaaaaaaaaaaaaaaaaaagaggcagggcacggtggctcacgcctgtaatcccagccctttgggaggccgagacaggcagatcacttgaggtcaggtgttcgagaccagcctggttaacatggcaaaaccttgtctctactaaaaaatacaaaaattagccaggcatggtggcccatgcctgtaatcccagctacttgggaggttgaggcacaagaaccgcttgaactggaaggtggaggttgcagtgagccgagaacgtgctactgcactccagtgtgggtggacagagtgagagtctgtttcaaaaaaaaaaaaaaaaagaatatgagtgaacatttcctgagtcttaagataaacaaggattttctaaccaaaaaataaaagatattataaaaaaggaaaaattgttagatttgatcacaaatattaaatatatctgcatggaaaaactattacaaaaattacaaggcaaatttcaaactggaaaaacacttttacaactgtgacaaaggattgatatctgttactgagaaaaacatttacatttatttataagaacaagaccagggccaggctcggtggctcatgcctataatcccagcattttgggaggccgaggcaggtggatcatgaagtcaggagatcgagaccatcctggctaatacagtgaaaccccgtctcttctaaaaatgcaaaaaattagccgggagtggtggtgggcgcctgtagtcccagctactccagaggctgaggcaggagaatggcgtgaacctgggaggcagagcttgcagtgagctgagatcgcgccactgcactccagcctgggtgacagagtgagactccatctcaaaaaaaaaaaaaaaaaaaaaaaaaggacaagaccaacacttcaaatgaaaattggacaaagttcacagacaattcagacaattcacaaagtaatatggaagacaactatattttataagttcaacgtcactagtaagaaataaacaaattaaaataagtctgttctggctgagtgccccatggctcacgcctataatcccagcactttggactttgggaggccaaggcgtgaggatcgcttgagctcaggagtttgagaccagcctagacagcacagcgagatcccaactctacaaaaaatgaataaattggctgggtgtggtggtgcaatgtacctgtagtcccagctactccagaggctgaggtgggaggattgcttgagcccaggagtttgaggctgcagtgagctatgatggcatcactgtactccagcctgggcaacagagcaagaccctatctaaaacacttttttttcctatcaaattaattttaattagttttactggcagtttggtgaattactgatcctcatatttctggtgggagtctaatttggaataactgtcctaaaaaagaaagatagatacatagatttaggaatatatataagcctgaaaaaaaaaaaaaatatatatatatattttgagacaaggcctcactcagttgcccagactggagttcagtggtgcaatctcagcttactgcagcctcgaccacctgggctcaagtgatcctcccacctcagcctcccaggtaactgggactacaggcatgcaccaccatgtccggctaatttttgtatttttttttagagatggggctcaccatgttgcccaggctgatcttgaactcctggagtcaagtgatttgtccaccttggcctcccaaagtgctgggattacaggtgtgagctgctgcgcccagcctattatctatattttttgaggcactaatttatgcttaggctattctaagaaaaaaactagaaatacaaagatttatggccaaaaatgttcagttcattgcaacattatgtataacagcataaaaacagaaacaacctaaatgtccaacctgtactatagattatgatgtagtcattgaagttatttttgaagactatataatgacataagaaaatgctcatcgtatcatattaagcaaaaaagaaccccatttattaaattatatttacacaatcctcagttttgtaagcatgaattctatgtcttcatctaagtcactgagagaaatgtgaacagatggggtttggaacggatggaaggttcagcaaagtcagcctcccttttctgggttgaggctagccctcttccattcctccattaactgaaccttcatctggcaatggttcccaaatgtttcctaggggagggcacataagaattactgtgagagatggtttagaaaaacaaaaacagattttggagcctgacccacagagatttcgactcaggaggtctgaggtggggccctggaatccgtgtcaaaaggcctccaagtgattctgatgcacagccacgtgcagaaggaaccacggccttctggttcgaggttttgaaaaggacattgaacaccttttgtaagtcagcttctgaatgtgagttagggaagataatgtcaggatggaaaaagccttccccctcctacatttctccaaatactctgttgctgcttgtcaggtggatgatgtgacaactggcccagctgctggcctgcagcgcttccctgctcggactgcagctgccagcgctcccctgcccaccccccgccccacctactcacctcctgcctacccccaccaccccacccagccccgcctaccctgcagctccttgccctgctcttcaggacttttgctccaagtcttgcctcctctttgtcttctgagatgccagctgctccctctccatggcttcccttctgtccacttttcattctgctgaggttgtgcttgtctttacccaaacccctgtgatgcttgtggccaggcctccttcccccaggcctagctgctgagaatttgacgcctcacatcccactcattcctcaacccgcgccatctggcttccttcaccaccactcacaggcacacctcttggcaaggtcacctggctcccaaaggctaatctactggttctgtttcagtccttttcctggaagcatctgacactactgaccaccacctctctccctggcttttgtgggggtcatcgttgctttacttgcctcgtatccccttttcttggtagcagcatcctcaggagctgccttccccagctctcaggccacgtggttggtggggctgacctccccactccccacatttcatgcccctgcccctaaggattggttcagggatgggcatatggtcagggtcaaaccaatgagactcaagcctgagacttttactggggctgctgagccagcagaattcgaggctggaaatggaggtggccgcctgcccacccctgagaaggaacacaacatgaggagggccacagagccaacagagtcctggtgtgtctcctgcagtcctgggccaagcctgaagcttgcacatcctggtctgatgggtttcaggaaaacgttcttatctttttatctaagctagctttggttggatttctgtcacttgcaacctaaagagatctgagacagcactgagccactaccctcccaggcaattacccacctctttggtactttccccggagggtctccacaagctctgcttcctctcacttaagagtcctgtgcaaggacttctacttcccagatgctggctactaaatgctgacactcccaagtcaacagaccagcccagatatctccctgagctccagacccatgtcttacccctcatggacatcgccaccttggtgtccactcaaacatgacaggtctaaatctaaacttatcattatgccccatccttcctcttcttggatccccatctcagtgaacagctgtactccccagttaccccagaaaccgaggcctcatgggtgacacctccccaccctcactccctggccctctttgggcagctaattctctgctcattcctcagggctcagcttttaggctgcattctcagggaggcagccttttccaacccgcaagcctgaatgagggggtccctcctatgcccccagccaccctgtgtttctagtgttacagcccttgtcactcagagctgtggcctgttgactctcttctgtgatggctggccccaaccctgaaatcaagatcatttgaataaatgaacactagcatctgtaggtgtgatcttatattgtatattgaaaatatagtctaattttctgtaaaaattaaatatctcaatattttagagagatctgtaaagggtataatatttggaacagaagattgattttcaggagccccagtatctggatgagtgtgagaaccactaaataggacccatagtttttctgtgtgagattttatttttttaaaaatagatgaaccaggctgcctattagtgaatgccttcacttcccttttccttaattactgagtctagaaacttatcaagggaatgaagcaggcctttgttcctattcagaatccatttccctgcttttttgaaaatgagaacatctgcctgcttccagtgttccaatacttttcatattcttcacaatttcttaaaagccaccaaatacagttctttgagcagaaatgcaagttctttcatccatgtgtccggccagagatttcctgaacctcgcctgtggcaggccctgggagagctcctcagcctgtggttttaatcccctcttgaacacagctgggctcccttctgccatctctggggcattttctttgaggaaaaggaggaagctgagtagttctgctttctgttaatattgcagcaagagcccatgagtgggccgatcacttcctgattcttgttcttgttctaatcataccttaaaaggcttttttaatgtccaaggcacttttaccttctcagcccactccagcttcttgatccttcataccgcccataaaccttgtctgcacccttgcacatgcacccctgccccttttttcccctattaaatactatagttaaatgttaatatctaaagtttttaaacacaattacggtatcaagcattttattaaaaatttttatcatactttgattttaccaacttgagtgttatgaacaatgaacatgtttatacattgacaagaatactcatacagggattgtgggatggctactttcactcccttttccctcatctttactcctttttttttttttttttgtagagatggggtctcactatgttgcccagggtggtcttgaactcctgagctcaaacgatccacctacctcagtctcccaaagtgttaggattacaggtgtgagccactgcacctggcccctcatctttactctttagttcctttgcccttgggttcttctagcttatttctactttgttttctttctggcatccatttctattttaaattattacacatagatgcagaaattacttggctggcgctagttgcagaatcatgaaaattaaatcacatgatgcttagtgttgaaagactgaattgttttggttttttattgagatataattcatataccagaaaatttattcttttacagggtgcactcctttagtatattcacaaagttgtgcaaccaatatcattatccaatttcagaacattttcatcacatcaaagagaaactccacgcccactaacagtcattctctatttcgtttgcatgcggctatccagttgtcctagcaccatttgttgaactatagtttcccccattgttctaatagtttttaagtggtttcttaggattctctacatagaagatcatgtcatctgcaaagagttttacttttttctctccagtctgggagtttatttcttttcttgccttatttccctgctctctacccttttaaagcctatatagtttcttgagtgacttccctcttttttcctcattagaataagttttctggggagagggaacagagcatatgaagggagaaagtggagctcttaaaaatgtgtagtttgggatggggcgcggtggctcacgcctgtaatcccagcactttgggaggccaaggcgggcaaatcacctgaggtcgggagtttgagaccagcctgaccaacatggaaaaaccccatctctactaaaaatacaaaattagccaggcgtggtggcacatgcctgtaatcccagctactcgggaggctgagacagaagaattgcttgaacccgggagggggaggttgcggtgagccgagatcatgccatggcactccagcctgggcaacaacagcgaaactgtctcaaaaaaaaaaaattgtgtagtttgcattcatttcaaatggacttcatactttttcagtggaaatgtcttccttcacagcacctggggccagggattttctggaggaatctttgaaatctgttttcctcaagttttggacacaagcctgggtgagctccatatccatccttcctcggctagtacagagtctaagatgacatggtcactttcccccatgcccatctcccctccttctctggccaattctttattgccagtcaaaggcagaagagccaacagcaataagagaagattcccaccatgtcagcacaggttctgtgtcatcagtgacctcttggaatgtgcaggaagccagggagataagaatctatggctatgtagattaggtacaccccacagccaagtatgagcttctagggcccaatcgctagaagcaaacaacccagaccactaaccaggctctaactaaggcaggatccaggatgctcagcaccctgggccaacccttccgctcaagatgaatccatggttcatttacagtgtctggggtgatatttaattccaagttcacaagtctccagggtagctgcccttttgtttggggatttcctcccgggtgctaaatcacttcctcctagctccaatctgaaaagcaattcaggtctcctgtggcctcaccaagcttcctgcccacactgattttcttctaacctcactggtctaccttgtgtacatcacctaacaacaaagccacttagctcaaggaaagcctcaagaacaaatggcttcctaataaggtgattcctccctcaccctagggtggcccacagctccagcacctgctgagaggtggccaatttggatgaggtagctgccaggaatcaaatctcagaacccttcataaaactgcgcttagctattccacaaatttctccaaataatgaaacagagagaagagtgagaatataatgagagagaaatctggaaaaatacaaaagataaattcatgttcctgtgagttgtattcatcttcctgggagttgataatcaggctggctagctatccagtctatgggagcagagagagggctgcattatctccaggttggcacagcatctagcaggggctccctgatgacacctgggcacaacaaggacctcacagcaaagacaaacaggaggaaatgcctagggtgtggggacatgccaccactaaattacaaaaatatatgcctttcttctttgtatgtttcaacagtaccgcttcccactcttgtaccacttggccataacactttattatccctagtacctaaaaactagacagtattactgagaccttaaatgtgacatttgtcatctttcaaggtgccagttactgtaatacagctatggttcattttgagtgtctgggtgacggtgacatatttaattctatttttgtcttgtccataagcaccaaataaagcaattttgaaattactttcttcacactcaatttattatctagaacgacatttcaatacacagtatatttgttttgtggaattcattcgcagtgtatctggaggcctggatttaacatatttcctgtagtgatagctactctatttgtaggaactatttaggtcactggagtggagaaaaagaggtcgctacttaacagaaatggcatgtatccaaatatagatgcagttttctcaacacctgttgcacatcaaatgatgaagagattgttacaatttccaaaaccctggaccaaaaccttaaatgatcagcactttgtttcaactgatacacggcttaagtcagaaaaataagttcttcttaccaaaaacagtgagcctaaatatgctggctgctttagaaataaaacaggtgatcaacaaagcaatctgtttctgtctaaataatttcccagcaaaagtcacttcttttgaaactatatgatttgaaccacagggtatgcacagtgattgtgtgctttcagaaacacggtaagcatgacaaatattttcagttgtcaagggtaagcgaggagggaatgacccacctaagaaatggaaactaacaaatagtaatatgacactcccccttagttccacaggctggtgcggctgctacacgcagctcacttcctacgggcggctaaaggcggtgcatgaactgaacgtaggcggcctctttatcccctccccacaacactgtggggtggcacgtaaagacctcaagggaagggggcctgggcgatacgctctcctgctgccattcatttgttcaagaaatagttgaacaaatgaatagttaaacaaactctccaactaggactctgtcccattcggataccctacgcctctccccccatttccatccctaggcatcactccctcgtcaagaatatgctgattatggctcgcgccccctctctcccttggaccctcccgccagggcgaccggacgaggccagcgggagcaacgccttccgaaccgcaaggaaggagggctcggagtgcgcagggcgcgggttcgcgggaccctccagcgcgcggggctggccagccggggcggggccgagggcaccgggcgccgagctccgggaggggtccccgaggtcgcgccggccgggaggggcagcggcgggaggcggccgactgcggcgcacacgtggggagggcggagcggggcgggagccgggcgaggggcggtgacggtacctgatgaaggtggtcttgccggtgctgtactggcccaccagcaggatcatgggcttgttctcgaagtcggcgtcctccagcgcaggcgagtggaactcgtggaagcggtacgcctcctccagcggcagcaccttgcgcaggtagagcgagcgcagcccgcccgtcaccgtctgcaccgcgtccgcgccgccagcgcgttcgcgcccgcccgcctgccgccccatccagctgaacatcctgccgccagtccacgctcggatgggaccctgctccgggttcgactctccccggctcgcact

SEQ ID NO: 1407 - DNA, 671070 bp, Homo sapiens
gctcgcgcggccggacattgtgggtgtgcgtgctggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtaagattccccatctctcttggttgcctggtatccgctcccaggcagccggatgtaaacaggcggttcgctctgcctggcggtgggctccgtggattctgatctgctcactgctctgtcgtctcctggggcttttaaagaactccttgtgctttcatttcttctcttctttatttttatttttagccgcgggagggtgaagggagggccaatgtgtggtagtggtctctgcattacctccccacagtagcttgccacggagatgatgatgacgatggaggcacggtcagccgccactcccgcctgtctcccccggcgccctgcgagcttggaggggtgcgcggtccgcgcaaaagtgcgcgccggggctgcacgcctctcagcttgcggggctggtgagttaacacctggtaactctttggcgagttgcgcctgtccgcttccgccagtgaccagggcagttctcacgtgcaaatgaaaggtactaacccttttgatttctttttccagagagccttttcgattgttttcaccgcttttccagtccctggtgcccttactgggatgcagagctttaaaaaatgttctaagattcgaggttctacttaacacagggaggctgctacttagctggaacgaaatagcgtcaaaattagaacggcattttgtttgtttttaacttgctgagtccccctctcacagctttctggacgttatggactaattaatgaaggatagtatctggggcggtggggaagagtagttgtttaaggagggttgactaagtctgcatctttcactttggcaagacgaaagacgttaggtagttacatttttttatggaaatgtattgcttttctaagaatcagggtttctttggagcttgaaggaaaatctaaacgtgggattccagtggaaaccctggtcagagggtcagagtgattgcttggagaaaatgaagcgtgggcgatgctcaggttctctggatggccaaaggagttttagtaggagcagaactagtcagggaaagttccctaaagcagataagaggaagaaaggagaaagccaacaggataaatgctcccattgtaggcacttcctctgacagttcaagtggattcagaccaaagagtgcaggacaccatgtaatcctgagcatctgtctttgagataaaagcagacacattaagtcactcggtcaaatttaaactgaagagtgattgcctgcatcttctatcatgccaacagcatctcctgtctttccattttaccatgtgtgtgttttatccccccaatgataaaattcaccatctctcctaggctttgtagaacaaaggtagggatgtttcacatacattcaaaaagggaacctcaccgaccacacatacacatagatgcccacagtcaaaaagcctgctgatgataaaagaggcactgggttatagctggattcccactgtagtagttttcatgcttttttcatgcctttagatggtacttaagcacgttgctcttagcaacaagcatccacaggaatgattgtttctgtggacaggattaaacaggtccgtataccattggaaatgtgtgtgtacgcacacgcgtgtgtgtgcatgtgtgttttttgtgtgtgtgttttcagcagttaggcttcaaatatggtaagtgctacagtatggtagtttgcccaatatttcgagtatttcatcctaattatgtggaatcctgaagaattctgaagtgtgtttgtgaatgagtgtgcgttactaagtgtgtttgccgactagatggaaaaaagaagacttggagccggaaaactgccaccaatactctaaggatttaattattgccgctctggtcttgcagcacaatatttgctgaatcactagattgttacactcgctgatcatttcatatcttcatattaaaaatcttggcgactgtagcagagtgcgtagcagctttccaaaagagctctctctctcacacacacgcacacacacgcacacacatacacacacacaaacaagctttcttagaccaatgcttactaaaaatgtctttaagaaatacggtagtaggcaaagatctccacactagtcccttgacaaccctaaaccaacagtccagcttctagataacctgctgttttctacgttaacttaaaacatcttccacgtggagatgcatttcttctgatttctgacctaagttgtggggaagaaggactgtgtacattgttactggaacatttccctgttggggctattttgatgtaatggtgggagttttattttcttctgggataaacacgttctgagtggattggatggttggttgagcacgtataagccactcttgagaatggttattttcaactttggctcaaaagtccagccagtgcctcatgccctggacccgtgccttggaagggaagagcttggagttgcacgtggcgcagctgccccagtggtggagagacccgccgcctctgctggggaggcagcatccagtgtcccttccatcccccacccttggcgtggctaggcgccggcagccgccaggcgcctccgccgcggcgctatggcaacggcggagcccgcccaggcggccaccccagccccccttccccgctagttaaggctctgtgttatccttccccttgctcccgctaggactgtgattcgacccagcgtcctcctgtcacctcctgcgaggtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggcacagtgacgtctctctagtgctcaagaaaactttgcagttacacccaggagcgtctctgtcctgtttcccccttaacctccagcctcagccgactcccacttggctgcacaggctggcctgctcctctgcagccgctcagcaaacatctctgagaaaaggtatccggagcaccgaccctagggtgctgccccgaggctctatggcagcgacctgagggtcaaccaagggtcacctccaggcaggcgggcgagcccctgacattgagtcttggttgtcaccccgcctttgatcctgtgttgggacaacttgggttttcctgggtgcccacccggcgggcaaggtgcattttagagagtcagttctcctgccctaggtcgagccagatgttctctggccggcttttctgggagcagagcctgcgactctcccaggcaggcgtctccagagcgctggcgcggcgggcacagggcatccagcgcgtcccagcgtatgtaaatgaggcatctttgtttcgccgcagctgcgtcccggccttgcccgccccaggatagggtgaaggcgggactcttccgtccgcgggggtgtgaccaattccacggcctctaagctgaactgcggcggcggaggtaattgaacctttcttttgttactttagccggtccttctcttccgggcatgcactgaccccagcctgtacggaagtgcgagggagctcagaagccagctccggctgtgtgcccggctggcctagggttcaccgttcgggagccctcacatgtttaagcatcctttttaagaaatcactccccaagctatcacttgtttccgatcttcaaggtcaggttttcattcaaaatctttatctgaactggaatttagagctccagtagcaaagacatcaacccaaacttaggctcctgggcaccatctccaaggtttccttgccgaattgctgagcatatggtaggccatgtcttcccttctgatgtttcgacctaacttttctcttaaagacaagccagtggaactgctctcttaaaggtttcccagcagaagtcttccctcccagacgcgctggggtctctttggcactgcacactgaccacctgtttgtgggacagcaatcacacagtcacctccttgcgtacacgaagaaggtgaacacagccagtttaagggaccacctatacgttgtgggataaaatcaacgtgagagagaacagaaagtgttcctatggaaatcccgttattttgctgggcatcccatttgctcacagatacaataattagtagcagatgtactgcaacatcgaatagtgagactgagcttacaagccgccactctacaaattctttgaaagagatttttcctcctttgagaggtgaggtgggcgggagggaggagtggccttacatctggaagcaggaaaactgactcttgggaggcggggatgggggagtaatagcggctactatctgcaacagataaagcctgaacacctgcttagctgagctgtggaatgcaagggagagaaatcattccaagaatcgccaacacaacgatcacactttaaaaaaatcagtttttctcataagttctcacttactcttaaagcttcaaagaataacttgatgtgatccatcaaaagaggcacaatcatttcagaaaatgactttgaaaaatgatctttttgtcttctagaaattgcacgctttctctacccagatacatgaaactcaacacattttctggctttgtgagattgtctttcagaagcgaacatggtttatacgtcagtagacatttcttcagactagctttgctttttggtttaatgcaagtgatcattacgatgtgttcattccttaaattctcagatgacactctttcaacatttactcagcacgggaaagttaatgtgaattcctctcacacgaagaaggaaaataccatagatcaaacgatgatgtatcattgattatcaaagccttttcaagttttctcaccattacataaagtgttgtctatgataacaatgacataatctttcatgccatttagttatcataatttctgataaagaaaatgccttgctcttttgtggtagaaattaaacgttcaggtgagagaaattacttcactttgtccttcagttattaagatttgactttgttatggtagccccaattacatttattgcctggaaattgtcagtgcacatttttgcacatcagattagaaactagtttactgtctttaaaatgtaacatacttaaattattaatctactgcatgcttaatacttagggcttgcaggagatccctgattttcctcagtaggatggtatgatatattgaaatttaagtgttgattgtttttcatttgggtagtgaaggtttagcttcaaagggctttcaatttgtagtccagttatcaaagtgttagaagtgcttcaattgaatcttctaccctaaatcttagcatgaaaagtgaggtcagaaacccctgaaagggaaggaagtaggtgcacatcatcattattgactagtctagattaaacactgaagaggaagatttcaatctgataacatcatagggcttcctgtttttctttgctgcttctgctgacaattttgtaaggtaattaaattggctgattgaagtcacagcggtcatggggcgataaagaccatttggatttaatggaatttaaaacaacagagcacagaacacaactcttaccgaacaagaattttaatggtccattcagggtgctgactaaatagaacgcccttaacaagtttaattgaaagggcaaggcagattagcactatatagtctttatggttgaagattggggaattaaaattatccctttaaaagactcattaatgcattatcaagatttaatgtaggttaaataagctttcttcaaacctttatcatatactgtgaacctaggtttaggaccaagtttcaataataaaacatttttaagagctgatttaataaatggaattatagatctttctcatttgaaaaaaaaaaggcatttaaaattgagcatatacagtgtgttgaagggtaagtgttgatgataaattctctatgttctataactgaaagaaaatttgacttttcttttaaaatttgattgttggtattttttcatataaagaaagcttgtcagtagtagagaaaccacagagacaataaaggaatattctttctgcagtttcaatagagtaataggtatttgatctattttaggttgtttttaaaatcctgaccttttttcttgctgaaacttctatattcagattattaaacttcaatgtagtaagtcccttctgcccctgaagaaagggtagatcactgcttaacattgggaacattgaagtacaatcagtcccaaggtgaaagtcaagcctcagtcacatatgagattattcactccacctgtttcttgccatgtggcattgccgactcagagttgtcagttccttagatatttctagaataacatgaaaccaaatttttgtataaaaatctcccaaattttaattgtatacaattttgaaaaaagcttttaaacttcagatttgtaaacagcaaaagcatacagcaggtgaggggggatgtggtctcatttttaccttctcgcccattcacatttcacagttcctctaaggcacacctgcttccctcacatctctttgatcaccaaataagtaaggtttatttgcctcttgcctcacacccttaaagcaaactatgttatattcttgtattttcaaagtgacagttacctaacctgataaaactaatttgtggtaaagtgagtggggagtttagaaaagactctaaaaacttttctgcaggattttttttttaatttttaattttacttttgcatttgggctttgagaatcctcttcaaagatagcagcattcagatatagtatttggtttttaggtttctgcctatagattaatttaaactctttattttcttagctaaaaactgaaaattcttttctggatttagtagaaaggtcactagacagcagggccatttgtgaagatctgaaagggtttggggagggtatgtcttttagttattttttctactgatacatatacttctatcagtctttctttttggttaagtattgccctgttccatggccttattttaagacaagtatattctggaagaggaacacatagtctcaagactgtagagttaggatgagtttattaggatcgatcgatactgtctgtgacagagatgctcagatacagaagaaaatactgggtgcctaagggagtgctgagtgattagcatgggtgtggaagggaggctgagaaaagagagaagttaaatgacatttgatacacagtctttttcaaatttaccgccagacatcccaatgctttgtaaattgatattttgcttgtattaatccaaatcttttagcataagtgattattttaaataagatgtaaattatattcttacattgacattttctccaatcaaaatgatttttaatgctttttacctccttttcaatcaattagctacttttctattattaaactaaagtaagaatttggaagatgttgcctctagctctcatttgtgtctccagctcagtctcagtctaagtccttgacctagcacaatgagaatattgtgctaacatgatcaaataaacaaaacaaatattaaagtaatgttctgcttctgaaatttcagtatattcatagctatttggtctattttatgttgtcatttaatccttcctttcttacctctccctttactttctgaagcttcctgcattcaattcatcatagattttagtacattcgggtccttccttccccagaagaaatgaaatgggaactctctcaaaatgaatgaaaactatagaatcctggattatctaagctaaaggggaactcaaaggtccccacgtttagagtcttaagtttagaggtgaattgccaaggacagttaaatagcttgttctaaattgcaattaatgtcagattttataccaaaacatgattaccctggctgccaaaattcaaaaaactgaattttgctgtttttttcagtgtagcctctgactccctgtgctttgaatccattttagaaagaaatctggtagctcccctagaaatgtgtctactttgtttcctttaccttttctttcctagtacattatctcatgggttattgctcttttctctttttttttccttaatgtgtagctctatcagcctcttgcatacctgcttacttgttcctttactcagtgtcaaagcttttgctgcatccattcattcaacaatattaaagtgagcacatattatgtggcaggcatttggaaaacagaattctaagacttagcttctgatattaaggattgtgtaatccagttaaagagaaaagatatgtacatattaaagtaccaattgtatggtacagaaaatatatacaatagttgtttaaatgagattattgcgggcttaagtttttccagaagagataggattctggctggtgcctgaaaacattgtgtggtagaaagaagggggaaatgtatcattggtggaagactcagcacaagaaaaggaatttaggcataaattaagaaaatgagtgttgggacagataatgggctagcactgaaggggcatagataaggccttgatttttcagagctttaatatttaggttacagggtttagactactgtgtgtagccactggaaagcaattgaaaatagaggatgggcttgacatggtgtgcaataagcagtcaaatgattttgcagtgtgttgcttacattttatgaagaataagtggatcttctttctcttactgaaatggaagcaaaagacacatcttggtccttgatcactgaaacctttaagaagttcttgagctcagatcaaagattatgttagtcaaaattctccagagaaatagaaaacacacatacacacatgcagcagggaggaagtgagagagagagagagagagagaagaggagggtgtgggtatttattataagtaattggcttacatgattatggtattatggatgctaagaagtcctaagatctgcagttggaaagctagagacccagtggtataattctagcctgaagaccagcagacttgaggtccaggaagattcagtgtttcattttgaacccaaaggcatgaagaaaaaaagaaaaagaaaacccaggcttgaaggcagtgaggcaggaggaattccctttttttctcaggagggtcagtcttttcactctattcaggcattcaactgagcggatgaaacccacccacattacggagggcaatcttctttgctccatctactattttactgattcagatgctaatttcataccagaacaccctcacagacacacccaaattgtttgaccaaatggctgggcaccccattaggcacccacggcctaatcaagttgacatataaaattaaacatcacccagataattccaaagcaaaattctgaaaggaaataaaggaatgtcttcttaagacatggccagatcaaatgattaagcaaggaaaagttaccaattaatcttaaggaaaatgcattagagaacaatttacaagtactatatacatctttgagggatacagtaaattgcccccaaggaattctcaatgttttatgtttagttccaagacatttctattacctgaaacattgtgtatgtgtgtgtgtgtgtgtgtgtgtgtgtgtgtgtgtgtgtgtgtgtacagttaagattataataccatatttttactgtatatattctgtgtagaaatgtttagatacacaaatatttaccattgtgttctgattgcctgccatatccagcagagtaacatactagacaggtttgcagcctaggagcaattggctgtaacatatagcctaggtatatagtaggctataccatttaggtttgggtaagtacactctgtgatgttcacacaatgatgaaatcacctaacgatgcatttctaagaatgtattcctgttgttaagcactcatgaatgtatatacataatatgtctatcaattatttaaaatcagaatttaaaataaatagaattaaaagttaagacaactttagtagaatagatttatttttagtaatattttctgattctacacaaactcaggatgttagaccgtgaatttagttgtttgggtcatgaattttactcttgattttgtcatctaatattcataaattaggaaaaataagtaaatctttctggcccttgactttcctgtctgaagaatgagtattatttgctacctgtttaacttccaaggataatagataatgttggatttaataggaaaatgtgtagagctctgagtttattagcagaaaaggccttttagagttgaaaaaaaattgtttatttactgtgtatgtgtggaataaaataatatttattatcactcatgaatattgtatctaacttcttaaactgtgtatatttaagaaaatcagcttttctaaattattcattaaaaatcttccttgaaatatacctcaattattacaaataggttggtaaggatttattaactaatagaacaaacttctgatttagttacttgatagaagagtaagtctgtagtttctttttcttccttaaacatcatgactttaattggtgttctcaaatatatacaacatcagaagaaacaaaccaaaactgaaaacaaataatgaacaaagaaatcatgccaagttctgtggtttaaatttttttcactttttcataagtatattgttctagtttacctacacaagtattttctgatttttatatatacatcattctttatgcatctgcctatgatgaacttttagttatttcaaggtttgcaaacatataaataactatctttgatccatttgtgttgattcaggaaagtttcataaacacttggatttgctacagttgtttgagatggatgtatgggactttccagttgttatattggctgcttaggcaatttttctggtgcttactttttaaggtagaacagattttggtaccacccctagaccactaacctcagcattcttccttaagtgtcctctaaactgacttaaaaaaaaagatctagcccagtgttgggggatcagcatagaagtgtctagggagagacaagagaggacaacctacacctccttgagcagtggtaccatgccagagaatccacaggaccatttgaaaaggtgtattgaacttaaatacaattttatatttgcaaaattaaaaaattttaaacttcaatgtataaatactctgtacacaaaatcccagcgacatgcaatttacctgtattacaagcctgcacatgtacccctgaacctaaagtcaaagttaaaaaaatgtaaagtttattgggaaaattgcctgactgttgaagatacttagtttttaatcagtaatttgcaactgtcaagggtaaggtggaggacaatcagtctcaagatttttacgtttatctgaagggcaactagactaagcacagtttgaaaaacaatctcctagcttaagctcaagtctagtttttgtgtttctggaaacagccttcccatgatgcagagcggatgttggaatatatgaagaatatttttgaatttttgcctctaatgggtgaagaaaggtgtcccattctttcatctttccctaaggattctgggttgatcactcaggaagacttcctggagattaggggtgatcttccaatgattcatcttcagcttgttcccttaaattcatttctctttcttttgctcttccatgtatcaactatctttcaaaatctaattcaagttttgcctcctgcaaagatatgttttagataggcattctgcagaataaattcaaacattgacaagataatttgatctaatcagtggttctcaaactttatatcagaggaaaggggctttacataatttaaatgtctggtccccaaacctagaaattctatagtttaatatgttactagatttagttagcatgttacaagtgcataactgcatagttctatgtggtggttcttagtccctttatttattttaccaaagtaactgtacttaaacaaaataaagatctcacacactgtgctagataatcctaagaagtttttgacctttaagtttatgattcttctatttataatgagcagcggcatcagctttcggaattagcagttgataatcatgtctagatgatgaaaaacaatgagtaaatgttgtagataacagttggggcttagatattttataattcttcacagaacacagagtgttggactctcagaacaccactcaagggcttattctttaaaacctaatcatttagaatatttatatccacacaaccaaccccatagcccaaagggatcttaaacaggtgttgttttataaataatgtctaatatgatgtatggttgtgagactttcctctctcaatctcccacactaaaggatcccctaatagattattttaaaactttgttttcccagacttagaaaaagaactccagcagacatttgctgtagttgagaggattccaacttttcagttgccatgaatacatcctaatggtccagaatctaggctgaaaataatgtccagcctagatggtatttattagaaaacatggaaatctcttggacaataccatggcacccccattcccatccctaatgctctgattatactctctggacctttgttacatcatggtgctgagacataaaatgtggacactacatttggaattaaaccagaatattcttatatatttgttttaggtagataaattgttaataattgcatatactgatttagtattgaaataaaaatggtttttatctgtctaaattattgatatctaagtgttttctgtattgattgcctcctcggtgaaacacatacgtttgttaaatatattcctataattaaacttgccatctagatacagacttctgtataggagacactttactgacagtatgatttaaaagtagcatgattataggttggatagagattccaaagtattaatatcatgataatcacatgctaatggaaattttaagataaatattgaagaaaaaactcaagttaacttcattatttctcagaagctttctttttggactcagctatgtttagcaatatgtgtctaaatattttcaattcttttaataataaattattcataggtgatttagcaattgagagcatgtaaatatgtaatttcaagaaaatgcatccagtggtgtgcagttctctggaagacaaactatgaaaaatccttctacatgatataaatttcacagtagcttacattcatatatattcatctaattatggttctaggattactatacctttgacctttctattggtacgggataaattgatatacgtaaatgtagaatgtgaaaaaaaattcacaacacagaataataattcatttattttctttaggtaagagtctgactttactaaacccgatagccacaagtaaatgttaatggaaaggttttcccaaggttctttgaatttcatacatgttttaattcctggcaggtagccagactatatcagcatttaaaatacaaaactaggatagaattttacctatttcaaggtagtatagtttgtgagtaaactgtggagagaattttaacctttaaatttgtttattgtttctctgtactatgtgtaagatgactaaacttggctacaaaaaatagctatatcttaataacaaacccctatttaaacccctatttagtataatttctctctctctcacccctccctcccttcctctctttgtgtgttgggggtgttattcttcaagaaagagagatgaagttaaatttatttaccagacaacaaacaaatgctttatgtgttgattgtgaaggaagatgctgaaagtttcctattaactctttcaatttcatttccattttctatttaaattgccattcatttcaccaaatatttattcagcattggtgtcttgtctggttttttaattatttgcataacaaagtaattgaaaaagcaagatataattaaaactttcagtaaatataaaaatttatctaaaacatgcttgattatttttagaaatacattacatgggggatcctaatgagatcctgattgtttttgttctgaatggcatcaagatgtatatgtttcagtttcattctataggttctgtttcagtatttcaattcaatttcttattataattgaaggattatcttagtaaccttaaagaaatccacaattaatgtaatttatcaatatgtatttatatttgaagatgattattgtctaacatttagagtttatactatgatatatacacaactattatattttcaagtctttatttatacaagcaaccagtcatacaatttgctatttgttcaagtctttatttatacaagcaaccagtcataaaatttgccatttgttcatttatttattctttcaatcattcatttaacaaatgtttaactgcttacccatgtgccagacacttgactgagcaataggacaccaataatttgaaaataaaaagaactggtctctgcatcaagaaggatatcatattctatagacataggtaaccacataaatacaaaacagtgtgacaagtgcacacaataatatgtaaatattctaacatgaagggaggcatctagcagttcttagaataaagtatttctaaacctgttgtttgcatcttgtgctaagacttggatccactgaggacctcattcagaagttttattcttgctatcagattagaatgaccatgcatttgtgctccttttctccactgcccccagcaccagaaaccctcaactagacctctagtatcaaatcatagtgatgccattaatttatttcttctgtatttttatatgattatatatatgaaattatttttaaaactagtccaaattattttaagtgtttagttactgtatttgtcaggatgtagattcggtgacatatcacagatcccccctggaagtccccaaagcaaaaacaaaaggtagttgttcacttctcatgtctctctgcagatttgggtatttcagggatggtatgctggatctgtaagtttctggggtctatgctgtttccagctctctagtctacatctttaaggaatgttgttttgcatgatctaaaaggatgctgtagtgatcgcagataccctcccagcagcaggatggacacgttttagatgttgcacacgtcattttacctcacatcccattagtcaaatagctattccctggtgcacagaaggctgggaattgagttcctcttatggaaaatgtacccagctgaaacatctcagggtcttttcttgtagaagatatgggatatgcacgttgaaagaccactggtagtctctgccacaagcatctgactaaatatttcagaaaaaagctctgtagagttttaaacttgtgtgtgtgtgtgtgtgtgtgtatgtgtgtgtggtgtgtggtgtgtatatgtgtgtggtgtgtggggtgtgtgtgtgtgttgttataaagtaatgcattgtagcttatttggaaaatatgaagtgtgaaagtgaaaataaaacctcccataattacaccatgcagctataatcactgttatcattttgtttctattaattcttgttaaaaattaaaacaaatattttggttgatttaaaacgtaatacatgtttattgtagaaaatagaaaatatatagaaaattataaataaatatcacccattatctcaccataagtaatattttatatttatccttgatcttactgtatatgttttgttaatttttttcatttaaccctttattgtggacatttttctgtcgtcaagtatttttccataactttttttttttttttttttttttgagacggcgtcttgctctgtcgcccaggctggagtgcagtggcgcgatctcggctcactgcaagctctgccccctgggttcacgccattctcctgcctcagcctcacaagtagctgtgaatacaggcgcccgccaccacacccggctaattttttgtatatttagtagagacggggtttcaccttgttagccaggatagtcttgatctcctgacctcgtgatccacccgcctcggcctcccaaagtgctgggattagagccttgagccaccgcgcccggccgtatttttccataacaatttttaagtgtctgaatttgtattacagaggtgcttataatttatttaccaatccctctattgcttgggttttagaatcatatatacctgaatttgaaactggctctccggcctttgagcaatatgattggaatatgctaatgaatcttcctaaattttagtttccttacctataaattgggaatgataatattatctaccctttaaaagtattccttggaattaaaatagataaaatagataaaatgcgcaaagtacttagtaaagtgtgtggcacctaagtccctaataagtgctagcataaccagtcaatcaatcaatcaatcatttaattaatttcaccacagaaagtacttgatttctgtaattgtttcagctaatttagatctgatgcttccaggtcttatcctgtctcttcaagggtggttggacccctgcagaagtcctgtgaagtgttttaggccagtgaggtggcctttaggaacacaaagggccagtttgtcaaccaggagccttgtgatctgtggagacaggaaacagacatttagatgggaacttacgggataacataagaatatctgtagttttctacaattgtaggctaggcgtgatccgtgttagaggggagaagaaggagctggtctgaggctggtctgaggctgaggagtgtggcctgcctctccctgcttgcttcctgggatgtctcctcagtgtcagtactggtgaggctggggcaggggaggagcagcagcagttttaaaatcagacttctctttgctttttgatttgttaagcaaattccaggtgtctcacttgctaatcacattgtcatctctgatgcttaattattttctttagggaaatgaagttgtttggggctttcaggaaattaaattgaacttcaaaaaccacttccacataacaattaacattttgaaatggataattcctcagggtttgttgctaggtgagtttacccagtttttcctttaagagatattctttataatagtggatttatttgttcttttaattatagatcatatttttaaaaattggacacattaaacatccattaagtccctagtaaaatgatataaaaatgtgtggccattgcctttgagacagactaatgttgtcatctatggagtaggaaattggtggtgattagctcttgggctctatatttgggagaagccttcatcattggaaggagttacatcttggcctgctcagaaaaaaggaagtagtttcaatgttagtgcagcaaaaatgcctaaaggtgactgtgctagtctgttctcatgctgctaataaagacatacctaagactgggtaatttataaaggaaagcggtttaattgactcacagttccacatggctagggaggcctcacaatcatggcggaagttgaaggaggagcaaagctactggcagcaggcacgagaatgtgtgcaggggaactgccctttatgaaatcatcagatctcatgagacttattcactatcatgagaattgcatgggaaaaacatgccaccatgattcaatcacctcccaccaggtccctcccacaacatgtggggattaggggagctacaattcaagatgagatttggttggggacacagccaaaccatatcagtgacttacatgtatgtaagaaggtgaagttccatgtggcttgtgggcatcattcccatcttctaatggagcctatacaacctcagcacaaatgttttcagtcccatttgaataagatagagattctagaaattctaggtgttgctgctctgtgccctcctaaacatgcctcctctagtcaatcagatttgtctttaacacatttaggctgcctttaagttctgcattttctactttgcctgcacacagatataatcacagtggaatcctaaatcttaatcactccacctccccctaaaaggatgtgggcgtagaattacttaaatattgccgtatgttagcctttgagaggcttttgcaagttatgagaacccaaccagttgctaataacctactattgcttctggcaatagtaggatctgatctagaaaaggcacggaaaatgtggtcagaaagattgggattctaggagaaattccaccacttacaaagtgtgtaaccttagtcaagttactcaacatttgaatgtcacttttcttatttgagaaataaagtccttgcatgtagaaaacatccaaaaacttccctttcttttttgttatcctgaaaatctgggtgtggaagaactgttgaacaataggttagctctatgttctacaacagactgtctctcaaatgcagagttctgtgtgtttattgactactagcgtcagcttctgtgcagctgagatacaaattcagccctaggcttttatccacagatctgagaggaggaaggcaggcaggcacctgtaattatagcagcagtgatgaattgcagctgaattgcatggtgtgttaaggcttttctgtgctggttggcttgggtattagtatagtgattctgggagtaacagacagtattttagcaagtgtttgtctttctattatccatttaaacataatcctagaatctccacagacatacaggagttcttttgttgctttctggcagtggataaaagtgtccatttttattaagtgctcagtgcagagtttaacagcccttttatggactggtactagattacgtatcgaggggtggggtgaagatagtttttctatcgacatttgtaaaaccttagatttgggtttccatgaaccagaatactgctctacagacgtcaaagactctaaatgttgcaaacgattgtcttttgtttcttcattttcctttttccaggttgcttggtcacaaaagacatctgtccacctgatctttccaagggagtatggtgggggtggttggggctttctgtgagggtgatagttaggcagggaaggaaggtgggagaggagaccactttgctttttctgcaaacccctgttatcgattaccctgtttgttcctttccccttaaactctcctaaaagaagggtcaattctctcaacatcagttgaatgaaaaatagcaatttgaacagcatctgcaaagtgacatgtataaaatccaaaataaaatgagtcctcaaactcatgtaattttcaattttctctcatttatttgaaagccccagtagcagggtcactatgacatggcgagaggatggaaaatctttatcagaatttattgagtaggctgttaataatatttttaatataatgtctacatgacttccctggcctttaagagtagaggtgtatcttaactctgccaaaataggaaagaagaaagactcttacacatccttcactaatcttcctcttacttactcttatctgactctttttctggggtagacagctatgatgactttttgtttttcttttttctcaactgaggcacgagcaggttttatttagttttcttacttttcctgtcacatgatctattctccccatggatgtaggacctattcctcacacctttcacctttccaggacccatttacagttctttctacctacaaccacccttatctcagtgtagctctttctttgtgtagccagtagcttcattcaataattaagagctcattcaggcctgtgcaaagaggctagggaggggtggaggtatttgggcctcttgggaacatacaaaggtggctgaggtcctgagagagagattctctacagctacagtggacatattttatagaccaaatattaacacacagttctgacatgtgagggtggatttagagggacggagcaatagtgtggctgaaactgagactgtctctctacacaagtagataataattgtatagtgctttgcattttatatgcatttacacacgcagtattcattagtccctatcataagcctagaaactgggtgccattaattccccttcacagaggaagaaacaggctgagagaggttaagtaatttgttccaaatgtcctaaatattgaggaatttgaagttgctttaggcttctgaccctgccttatgttcctttcacttcaacaacttgaatgtagttgaatttcactactgtttgattgggatgtgagattctccaatcacactgtcagaaccaaagcaggtgttgcatgctgtaacaaaaatgttttccttggcaggatgagacattgctcttctcagatgaccctcaagcagcctttcctaattccggttcacttcatccccaaataaaacacataaaagaatatgctgtattctaacctctagagtgcagcccaatgtgaagataataataacagtgaaattaataatgatgatggttactctttgttggatatctgacagatggcaggtacaatgcaagtgtttttcaaacattatattatccaatcctcagagcaagttgatcgccctcattttagaggtcagaaaactgaggatacagaaagataagttatttacctggggcttcccacccagtaaatttcagagtaagaattcaaatgtaggtcagtctggctcctgagcccatgctatctagttttccatgtacacttttgcttgcttttgaacaggagtaagctcaagaaagaatataaatacctacattatatttaacgatttgttcataaatattaactcataaacatatgaggttgaaccatatgaaattgctaatatttggacattgtggaccaagaaaaatggtcatttcatgtggcttaacacaaaagttcttaaaatgtggcctctggaccagcatcatcagtaccaccagggaagttgttagatatacagattctcagattccatcccagatttcataaaaaagaaactaggggtgggctcagcaatctgtgcccgaacaggacctttaggtgaatctcatacccaccaaagcttgagaacccctaattatcctaatgtatttgttaaacagcaactctgtgtcaggtgctgtgtgagccactgggttttcaggaagagcagaaatggacatgcttcttaccctcagagagcttactctttactggcaaagttccacgatgtgcaaatatgaaggtttttttagaggtatttatattgtattagagtttctaggtctctaccaaaagaatgaaatgtttagaggcacaattagaggggaaaaagggttaacatttcatcacagagatggataccaaccaagggagacaaactgatccagggactggcgtgcaggaaaagacatggggccagtgctctggactcagtgctcaggacacagcactgtcaaaccctatatcttggactccttttcttccccttctgtcatcttatctccaaggatggctctgttcactttgaggccatgtttggatgggaagagtacactaagtccacttctcagcatgggacaactcgggatgtctaaggtagggcttggtctgcctccactagctggccaagtagatactgatctgctgctaccttctgctctgaggagctccattttgtgggcaggtggcaaggtctcaggaaaggctttattccagaactttgcctttctctctcctgtaagctacgcagcatgacatggaggatggcactgcctttagcatcgtagaagttggcttagggtttactcgcacggaagaaagaggaggaagcaggggtcattgggaggtcagtgggaatgaaggcaatgtgggaccttccagttgtctgcgtctccccaagcctgagaaatggtgctccttaatatatgttcattaatcctttgtcattccaaagggagaaagggagacattcctaataatcttccatttactaagacagttttcagtcctgaagggttaaagaacattactttattgagtaatgtcttaaagtcagatcatcttgggttcatattttcttaattttttaaaaggaaagctgttttttttctccaaaataacacctaagtacaaataaggcaggttgaataaatccctgcttttttggaagcatcacaaggttatttgttccaccaagtttccaaagaaaagggaataaacatctgttgtatgatctcttagagaaacaacaataggatttttaagcaatctcaagtacgtgagcatcaaatctcacttgaatttcatcccttccattggtaacatgttagaaaataatttgatggaaaatttcatggtgagattggaatttgaaggtatttagggagaagaagaatgctttgtgacaatttaccttttaagttaccaatgacacttttgtatgacattaaaagtgttgctcctattattaatacttcatttgaattaaattcccaactcttattctggccttgttataggagaaataattcacatacacaaatagcagcagttgtgtacttaaaggcaagccaaatgcatatcatgcatcagaaatggaagtaccacctctgagaattcaggagtgttcacataatcggcacaggtttttacccaattgattaaattacattcctctgctttaactgagggggagtaattctaaaggttatgaaatcaatgcaagctgctcttggattgtattatttacttgaatttaggatccagattcttctcatcacctgaaagacaaatcatatttttctcctggagtccttcagaaattcccagagtaggctcaagtattacatgaataattcattttactcactacacattacagcacttaacaaaggctgcggccagagtctcctccttggggaagctaatttggagcatcattatggttctgattcccaatgtttaacagctttgtgacctacctgatgaagtcctttttgttcagatctgttaaagaaaaacttcaagtttaaaatttcattgagaatattattagaaggaaatactcccaggctttcacatttactccacccctgcctttgagtaaaaagattaaaaaaaaaaagaagaagaaacaaagagacacttttgaatataaattcaatctactgcccccaaatattttcttaacattgaaaaatcaaatgacatgatttaagtatcatacatatatttccccttgatttattcaacattggaactcaaccagaaaaaataattatgtgaatacatatgtggacatcacttagaactctgtgtggagttctgtatattttccttggtttacagtgcattttttcttatggctcttatgggaattcatctgaactttcatgttgtcataacacttcaatgttctctcagttataattcattaccacatgggatgagatgggctgtgcactttagcacatgctgaaatataaaagtctgaaggcactgctgactattcagctgactctaacaatgaccaatatagagacaccggtctttgtatgttactctctttctctatccatccacccccattcagacaaacccttggataaattgaacactcttagataccaaaggttagaaatagtgagttcttcagtgactctaatgagctcacagctgagtatattttccagactaacttagttttgaatatcaagagagacccccattttattcatgtgagtagggaagagaaacttgttcttaggtatactttaaaaagctctatttttaaaatttggatagacttccctcgtgttttccatagcaacagcaccattttacagtcctgacaacagtatacgagtgttccaattttccacattctcgacagcacttgtttttttatgtatttatttttgaaagtagactaacagatatgaagtgatatcattcattgtagtctgatttgcaatttcctgatgagttgttttgttgagcatcttttcatttaccagttggccatttgtatatcttctttggtgaaatgtctattcatgtctttgccaactttaaaatcaggttatttgtttttgttatttttgctattgagttgtaggaacttcttatacagttttgatattaatcccttatagaactaccttataatcagtcaatccaacttccaagcatttattcaaaacttttgatactaatcccatattgaactaccttatgatcagtcaacccaacttctgggcatttattcagaagcattgaaatcagaatcatgaagagatagctgcactctcatgttcattgcagcattattcacaatagccaagatatggaaacaacctaaatgttcatggatagatgaaaaaagaaattatatggaatgtaaggtagctgtgggagtggtaaatgtctacagccagagtaaagattataatgattactcatgaggatttgatttctcctatggaaaatatatgtatttgggggttgttactattttctgtaaagaaacaggagattcaacttgcaataaaattcataacaagtgctatgaatcttgctctatccaaattttttttcttcagaattttttttatttttttttattatactttaagttttagggtacatgtacacaacatgcaggtttgttacatatgtatacatgtgccatgttggtgtgctgcacccagtaactcttcatttaacattaggtatatctcctaatgctatccctcccccatccccccaccccacaacaggccctgatgtgtgatgttcccattcctctgtccatgtgttctcattgttcaattcccacctatgagtgagaacatgtggtgtttggttttttgtccttgcgatagtttgctaagaatgatggtttccagcttcatccatgtccctacaaaggacatgaacccatcattttttatggctgcatagtattccatggtgtatgtgtgccacattttctttttttttcattttttaaaaattattattattctttaagttttaggttacatgtgcacaatgtgcaggtttgttacatatgtatacatgtgccatgttggtgtgctgcacccattaactcgtcatttagcattagttatatctcctaatgctatccctcccctctccccccacccacaacagtccccggagtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacacgaactcttcattttttatggctgcatagtattccatggtgtatatgtgctacattttcttaatccagtctatcgttgttggacatttgggttggttccaagtctttgctattgtgaatagtgccacaataaacatacgtgtgcagtgccacattttcttcatccagtctatcattgttggacatttgggttggttccaagtctttgctattgtgaatagtgccgcagtaaacatacatgtgcatgtgtctttatagcagcatgttttataatcctcttggtatatacccagtaatgggatggctgggtcaaatggtatttctggttctagatccctgaggaatcaccacactgacttccacaatggttgaactagtttatccaaatttttatagataagcataaaaactagtagagacattagatttaataaatactgtagaacaattagtcatactactgttgactagcactctgttgtaccagtttaattatattttaacaagtatattttattatataatttctataattatattgcataaaacatggaaaattgagagagtaagacatcactcacaagagcaacttcacacaactgctgatagtatttcagcgtattccatttcgtgtttttccaaaatgcatcttttttcccaaatttttactgtaactgtatacaatgttatcctacatttttcactttgtattaaagttttaaagacagcaaggcatatttatttttgaacaattgaattttcttgcaatcaactcatgtatcacaggccaattcaaatttatgatagactgatttttactggctttgtttgctcttttcctagacctttaaaatctaaatttctctgagaattgtcaactctgctctctgcatgcccagcattcccctggcttctactaacactccttttgcgttattcctgaggagagttctgtcctgtcttctgagcatcagttttcctctccaggatttgaagggcatactgattggcaagtctcactagcactgaggccatctattattcacaagttagtttttcctcgtgaatttcctttttgttgttgttgatggacttttcattctttcagacttgaaagcttggaggcatctttgatttctctttttcttctttacccacatctattgagaggtggccatattgtgatcattacatcttttcgctaagcattcaaattcctaattccagtctttattaataatcttccactttgtgtattgagacacagtacaacactgtgcttaaggtgatgggctctggagccagacctctgggagtaaaacctcagctttgttatgtatgcattagctgtgtgacctgtggcaggattcttaatgtctctccttgtctctgttgtgtaagatgagtaatactatagtacttaaccaacatggttatggtgaagattacagagtgtcttctagctattttgaaacatactataaattcttaattatagtcaccctgccacgctattgaacactagaacttatttcttctatctaactgtatttttgtatcaattaaccaacctctctttatcccccctcctccctacacttcccagcctttggtagccaccattctatttgttactcccaaaatatcacatgtatgccataaacatatacaactattatgtatcaatacaaaaatattagtagtatcaggaaaaataaaagtatcaaatattaaaaagtttacagaagatctaccgtctacaggcactcaaatggtgtagcccctgtcatatttgtacctgcctctctctttctaatctgtcctatgcactactgccagattgattttcctaaaatatggttttgctcctactgattccttccgttttcttccctttcacccttcagcttcaataatactgcttgctaaatgaaattcaaactgcttggcctggcatttaaagtcctacataatcagatttttaagacccctttccagcggtcctctgtgctctagacaatccaaacaatatgctatgttttctttaaaggcctagtttaagggtgatatataatatgcttaatatcctgtaaagcacagacacatatcccaatctggagtcaggtcttagggagccagccatgccttaaaatgttagttgtttaattgtgagaggccccatgagaggggcctgtggagcttggatggcaggaaggccttggggaaggttggggcagaagccaattaccacatggtatggaagtatctcaatatattaacaacttctacagctgaaccaaggcatgacaactaaatgtcagcattggccaggtgcctacttcttgacaccgctcctcccactcattgaactttttgttgaaatttcttccacattcaataaaacctttataaagtgccatccccattctcattgctctgcttttctgaaattctgtggttcatctaaataatcctgttttggaagttacatatttgtcttcccttttcatagttaactttatccacgaatatatttagttacatatggttacctaagtagctggaaaatgtgcatgaaggcaggtactatatacttttcatctctgcatccataccctggtgctgttatcgtaaagtgcagccagtcaatatttgctgaatgaacaactaagctggcacaattcagtactttattatttttctagcaaagaatgtacctgtgctccctggtaattttgaatatggattacaaattaccagatttgaattatggcaatactttgtatcggtaaattttgtgtgcatgaaaatataaaattttgggtagaattaaatgattcatttaggtgaattggtcattcagtcagccagtggggtcattctgtgtttagtcagtctgttagtcagtcactttgtctaccatttatccattcatttattcattcacttaataaatgctagcaattcacagctaaaagatgttggtggtctctgtgatgtaaaatttctgggatgcttcgatggatcacagaggcaatgggtagtatttttgagaatgttaaatgctttgctaatttctaaccttcagatgtatgtactcggaaagtggttctggagtcatcttttgcttaacacatcctgctattagattttctttaattagctcattaggaattaatatctgtgtttgaattacaaatccacattttatcatctatggacaaaaatgtcagcgattttgtttcatgtgaaccagaccaacacacagtaattatttctgaatatgaaacacgttaaaaataaaacaaaaatctggagttcccttgagcttgacaattaccttgttgtctactctgtttgctagttaggcactgaaaattctttaatacagctttgatttgttaacatgcagtttttaaaaatgctgccttccttattgaagtgagggaaatgcatttctactggttacagatatttttacagaattaaatgagaggaacaaaaatgaatggattttgtcagtcagttgccaacacagaagataaggcctaaggctttggtcatttaacatttgtgatataattttaaaaatcttagtaggattaaagaatatcacattctattatttctaattcgatttttagaagacctatggaaatgttgatttaaaaaactatattgaaataaaaaatggttcttgcagttacgtaaggaaattattaacattattaaacaatatagaatccttaactttgacaaagaaccaagtttgaatgaaaatacatatattagtttaaaaaatatgtaatgagaatctataaaatcatagagcttaaaagcaaaggacatcttaaggctttgttcagtagccttgtttcctctcctaaggaacgttaagtgttgaagtaattagtgttagtctgcaggtgggtgacagggggttagacttctgctcacatccctgtcttcctgctcttccactgcatcacactgtcattcttttaaatatgttttatcattgttctttctcctttcaaattcttaggtttcttatcagacttgctgcattagaattctaagacaaagactttgaaaaattcaatgactttttaattaactacaactttaaaatgctgacatttgcacctcaacctgagtccaacttactaaacattgtgtgttttgcaatctaattatatgttctcttgggaatagcaaagtcatagtgaccttggtgtccccataatacctactgagaatgacacatatgaactgaaccggatcttcagtcaaaatactttacaagcagctatttacttgttattcctaattcaggaaccacaaggtcctcaattttgtaaatggcacattcagaggggaatcaaattgcagatgaatgagagaatttacgtaggactaggagacatgatacccttgttgctcgtaatgtttcattaacacttaactagagagagatgtagtgcacaccctaactacatatgcactgtccttcttcccttatattttcagcagggtaattcacagctgtgagtcagaatgatagcataagggcttcagagctctgatcacagaccaagaattatcttggcagagaaatgaggagcagttagtaccaagagcctaaaaagaaagtgctaagtagataattaacatcttttctctcagtggcaacctggaaaagttcttggtaaggagccataaagaggtctctggcctataagaaggaagaaaaatgtaacagacttcctgaaaaaaatggagagggtttttttctttttttctgttttctttttttccaattatagcagcactttatttttccttacacaatgacgtgttgctggggcctaatgttctcacataacagtagaaagccaaaatttgttgtcatttcttaaagaattgagaatagtgtgcaaaaatatcttacataaattaaaaggatgaataaatttacaggtattaatgcagacaactttcaactcctggcaagtaacagcccacggtgttctggcaggaaaacaccaggtaagaaaggaaactgggtcctaacgcttggacttctctaacctttgtagaccagcaagacagaaacaactggttcaggagctcttgccagcctttagagaaatcctggaacactgagctctgacacattaatacctgcacagatcgacagactgctggtcacacagactcaccaaaccacggacttttcttccacaatcatgttctcacctcagccactgagtgaccgagttacatgtactaagggtttaaatccaagatacatacagggtattaaacaaataccaagggaacagttaagttcaatacaaagtcaaaatcagcagcaagttttataatccagtgctggtaatcagatacaagcttctgggacaaatttcttttcaaaggcttactctagtttcatgagactagcatgaagtgttctgaattaacccatgcagcaaatgctacacatctgctcacagcctattctgctgggtgatccacatctgctggaaggtggaaagggaggccagcatggagcttctgatccacaccgagtatttgagctcagtgggggtgatgatcttgatcttcgtggtgttgggtgtccgggcagtgatctccttctatatcctgtcagtgatgcccaggtatgtgattgtgcctccagatagcactgtgtcagcatataggtccttgtgaatgtgcacaccacacttcatgacagagttgaaggtggtcccaaggatgcctcaagattccattctcaggaaaaaggaaaagcgcctctggacaccagaacctctcactgctgatggtgatgacctagccgtaaatcagcaactagctcctttccagggaggaagaggatgccatggtggccatcacctgctcaaagtctagggcagcatagcacagcttctccttgatgtcgcacactatctcccactaggcagtggtggtgaagctgtagccacactatgtgaggatcttcatgaggtccaggtgcaggatggcctagggaaaggcatagccctcaaagatggcactgtgtaagtgaccccatctccagagtccatgacaatactagtagtactaccggaggtgtacagggacagcatggccctgggtgccacatacatggcagggggtatccaaggtctcaaacatgatctgagtcaacttctctctgttggccttggggttcagaggagcctcgggcagcagcactgggtgctcctcaggaaccacatgcagctcattgcagagggtatgatgccagatcttctccatgttgtaccagttggaaataatgctgtgcttgaaggagtacttcaatgtcaggatgccatgcttgctctgggcctcttcacccatgtgggagtccttctggctcagttccagtaatatttattggaaccttatgctatctctgatgctgtcctgtgtgcttactagaaagacaagtctttactctgacagagtttatattctggtgctgggggcgcccaacaatggaggggaacatggcttgggggcgtcatccccagcaaagccggcttggcacatgtggcgccattgtcaaggacaagtgctgtgaggctcttctttcactgtgatccatggagagtgggttggcagtggcaagtgaaaaaaaaggaaggtgttacctgatgtgtgtgtgtttggtgtatttctgtatgtatagaagagaatgtgtgaccaaaacaaagttaacttatggtattacatattacttgtttttaacatcagtttgaccatttgaaaaatggaatattggttatcactttgttacttggcctgcatggatactttataactactgatttaatagtattattaaaggggagacatttccaacactgaagtggttcaaggggcataaagcttcctgcccatgataacatcacccatttagtgtagacccacgtgcactttttttcaggcatggatagctggcatggggaatcatctaacactccatgagatgtgttcccaacaaaacattatgcctcattagaaagcgtactctgtattgttttttactgtccacatacaagaagctaataatacactttgagcaatttttaaagaaattaatactcttgcgcataattaagaaccctgtggctatttaattgttgctcttctcattagaccctgccctgctccctgcagataccccatgctctcatatttgttccctcttgccaggaccttctcctggggctgcctgcctataatttaatcaagtccctcgtccatattttatattttatatatttttctgccacccctaggaagagttgcttcctgaatcattcattgaactaatatttactgtaaccttatgctgtctctgactctgtcctatgtgcttactagaaagatgagtctttgctcttatggaattctagtgtcttaatcctttggagtattcttaagttattttggtaaactaatttatactataatatcagttgcaaacattggagtaaatgatatttaccccccagataatacccaatgacaatccactaagtaaacatttattgagcgcctaacaggttgtaggaatacaaagatgaatggggttctgtcccatattctcataatctacaggaggagattgatacctacatattgaaagtgatatttaaatacaaatgtgcacttctattttgtctttttgggaagaaaaattcattttaatctatctaggcattcatctgcttagggtgagaggagggtatgatgaatttgttatgaaaaagataatgataatattgtttctgtcacacaagaataggattaaagagcacaatagtgaccatataagctaggctattttcttgagaagggatcatctaaatatttttttcttcttctttggcaaaccaacaaagaacaaataagtgtggaagagtgaacattctccactattaaaacattatacatataaaacagaggaagaaagatctaccccctttccagactctgtaatttcaaggaggaggaggaagagaagggaatgaaactgacataaggtggtcaggccaaaagagactcagaggtcgagtgtttgagacacaaacgctgagttgagatctattggcctctcatggcacctcaccctgaggctttagaactgaaaaatcccaagagaaaatcccagaaaatcccaagagattttttttctgtaaaatgaaggtaataataactactcttgttgccgttgtgagaatcatagacacgcaaaagtatgtaaagtatccaataaagtgctcggcatctagaaaacacttgagaaatgcaagttacctccatttcttttcaatttaccttctggcaggactgaatcaactaacttcttcaaggctgaaaagcccagaatgcagactggcctgacttgctgcttttatacctgcgtgacgtgcagcaaattgcttaaccttaatttcttcatctataaaaatgaggataatattagcaactacttcttaggatggttatgagtattaaaagagataacagatgtaatggcctcagctcagtgcattgcaagtggtaggagtgcaataaatatttattattgcttatgtttttgttccttttatgttgtctgatctgatgtgtctaaaaattatctttattttttttcttcattgaaaatctcctacctcaggtactattctttttttttcttacttattgttttaactgtattttctttatgctgaagagcaagatatattgctttgcatttaacattccaaaacagagcaatggcccatagagatgagaacatttttagtctgaatctagaagtgaacggtttgattaaaagagaaaactctacatttatttatcccctgtttgcctatatttgcagtcacccaattaatgatcaccagttgcttatgtaaattactctcaagagtagcttaaggaacattttatgagtcgtacaggccaggaatagatcttaaaatagcgactagagagttgaagtccgcctgtactatgctagaattaatagtgcatgacctgtcactgcaacgaggtggccccaaattttactgtagcccgctgacacgggtatagatgtgacttaaaggtcacccttaaatatagaaaagcatgtggccatggggtgttttagacactaacgtgcaaataacacaaaagtgggcttcctgcttgctacttattcctgtgtgtgagttgggactaacagcagcagagttctagaggccttcagcccatgctccaattggaggtgaggaagagaggatgcaatgggatacatatcctaggaccatttgtgaggaaagtctctgtaatcaaccctaaagagtgacgtggcctgagagatgagttctcatacaagtctctctcttctcaggcaaactcgaaatagtggaatttcagagctagaagggatcttcaatggcaaagtcttggtccaaactttcacatactttgtaggtgtctgattcagtgaacagaatttctgacatgcagactttcctcactaatttgaatatttttttttttgttagaagaagaagaaaaatatgtcatttatacatttttccatcagaggagtttgtgaatcttgggtaaaattttatagctctatcgagtttaacagtttgaatattaaccttctggatgtgaagatttaaaatattttattttcctactactttctggaatgagaccaatccttttacacattagggggattttcctggcctttctgtgtttatctaacatgtcacacacccggtccctcatggtgggctgccctttgttcttgaggtgagacatgtcagtggtggtaccactgtaaatggggcacttctctccccagctgttcaccataattcctgaaagggaaacataaaccaaaggaaataaataatgttttgcttatttctctgcagctgccccgtgaggaccctgggtacttggcaaatctgtttttgctcctgaggaagagcctaaggagaaaagaaattctatccagagagatttaggttgcacaaactgagcctgcactttcaaagaaaataatagatcacatagtcccaactcttagagttattatttttttcttttccattgactccatttttccttgctgtacaacagtttctaaagcagagtttttgagtgctttcatccagaaccaatgagtgtacttttctattcttctttttttaatatagtgtgactcagcagtgtgacaatgtcttgcacttaattccccagaagttattgtgaaccatggaataatccttacctttgtctgatgtggcactttctgctattcagaactgacatcactcccttcaggactcaatctctgtcctgcttaaaccatgccaagatttagacaattctcccaattaactacattgtgaaggcacacggtgatttttttttttttttggcaataaaagaaagttgaaaacagacttttaaaattggggaatagcaacccccttcccctcaatcccctcctccaaataagccacttttccagttttttcattgtggtccagaagttgtttttctcccagtttgttggtgacatctccaggcgtctcccttttccatgatctccatgccagtggcttagtaaatttcctttgcacacatgatttctaaatctctatctctagttgtgtcttctttccatgctattaaaatttcctttgatatctcaagatccatgtgcccaaagatcattgttttgttcttttcagaacccactttctcttctgattaatgccattgacattctccctctgacacttggactcagcatcttagatttgtctttgacttttttcttcccttacttctcaagtttaatcattttttcaggacttggagacttttcaatatcaaagcttcctggatctagcttgtctttacatacatagacaggtactcattacttttacacatgaataattgcagtggcctcctaatttgtttctttattcttcccttcttttatttcatatggaaatattcaaatgtgcgcatatatatttttaaaaagttatattctttatccttttcaaaattcaagctaagattctctgttagcgtaatcttgcctatagcatttgaaacaagatttggttaataaacttcctatctattcagagtacagtttttcaggattaaaatatttgaataagttgatgtacatgtgtatatacttaaatattaatatagctacattttactaattattcatttttatgagataaataggcagtaagttcaagttattttttcaaactctgttttcagaggttcatgtatattttattcctacaatatgttttttgagtgattcaggatagtgcacaaaacagaaagcttgactgaaaagataatgattttttttttatactgaactcttagtgacattgttaaaaaaatttttttagctgcaaggctgtgtactgagacatttagcatttgccttgtaagaaaaatgttctgtagcaaaacttgaatagagtgggggtgtggtagataattaggtttcttccatatttagatcctatgatttatgttacccccactcttactggagcaagatttttatgtgggagcaagaactagtctggatagagaatatataatttggggaattggtatcttcagcaaattttcagattcttctcagttcattttatgtataaatcttttgtagaactaaatcaccagatttaagatcttttagttttcctttcttattttatagagttttggggaggatttggtaaaagtcaataatgatttaaagtttattattattattattttttattattatactttaagttctagggtacatgtgcacaacatgcaggtttgttaaatatgtatacttaaaagtcctatataatttaaaattatattgtaaatttcgtctaaattaagattaaaatggctcaaatcatcatatttaaagtagagatcttgatctagtttacagttatgtattgcatgaattttaaaaataattttagagttcaatacctatatggatatatatatatatatttatactattttgtaaacaaattaaaatattaaaactcacagtgtccttactacagccaatggttggcaaagaaaatgcctaaatttactaaagactgaggagagatattctatcacttgatgcaagcaagcaacaatagaccacatggctgacttatttctatactgagaaaaatcctctgtttccattttcacaaacagaatgaaaggcattagcaaaaatgtcctgctgcattccttcatgagacctatttaggtaatggaaatcttagcaaatatattccttttccctttattgataatggtctagctacataatagaaacatcatgtggggagcatctaatgtacctcacaactgccaacaacggtgtgaattaggacaaaaaggattggtctatttccatttacttcaaagatccttttaatattctttgttgctgtagactaaatattgtgattaaaatttccttctctatttcttcattattatgcttttaacaacttgtaatttcacaagacatttcttaggaataagaaagtgttgtaaataaatgtggatacattcttaataccttagggagtgggggcaatagtagcatattgattcacttacagtacatacagtataatactacttattttcccaaagtgaccatctgtccagcttgccagcttgtcagctatcatcattcctctgagcttcagatcctcgcccgtaaaatagggagagatacagggttattgtaacaagtagaataaatgacacacaaatcattctaatagagtgcctggtacttcccttatatacccttccaagatcactcctcactccacccttgttccctcgatgatcttatgctttaattgtgagaggcaaaaacaaatacaaaaggaaataaaggatgaagcagtgggcggagaatgtagactagtggaaataaacttgacaggaagcctcctaaattctagtagtcctagttttgctaccaaacagctatgataccttgcttggatcacaaagtctttctatatctacatattgtccatcaaatgaaggtttaatgggggtatttattaagtgccacatttgttatatagacattaagtctcattgtaattctagcatgttagtagtccttgtgggttaaagtaagtgattagggaagatatggaagaagtgggacatgaaatgggctttagaagttcattaggatttggttagctcaagggaagacatttatttgttgttgttttttttgtcttgatcttagccaactgaaatgttttaatttttcatagaatgacataattgaccagaatgatacgttctgaagtgacactggccattaacttaattgctttaattctttagatgaattttatttgagagatttataattctaaaagataatgcctcctgtaaatagctccactatcgtacttatcaatatgtgtggaactcgtaaatggaatatatattggaaactctttccaatacagagtcctttagaaagaccaaaataatgtagccacattgtgagattgccatcaagaaatgtgctcaacatcgttctggcacactcttttaatgagtccatatttgtgattaataaatgcgtgaaatcattactttccagtaaatatatataaggtaagatttcaaagtgacatgtcaagtatgattagtatttcttcgcattaaattgataaggaacaatgtgctttaaaatcatagtcacagactgggggatttaagagccattgccacacagatgacaattgaattcctgagaacagattagattgcctagaaaggacaaatttgttataaggcaacatgcacttttgtaaactgcattgatttttgtgctaataataacaatggttattgaggttgttgataagtgtatagaactaatgaggtttgttatattttaggtcaacttggtgtccgttactttcagtcccaattttatctcagaacttctaaacctgagatgtaaaataggctacatagatatcttaaacaattgctcagctgctttcaatgtacagctgaagctcagtgaccatctgtctggtgcgctgagtattctaaatcctaaaagtgtatctcattgggtctatatatgtttatatcatatggattattcttactgttcattgttccatgggactgtagtttgggcactaatcccttacccagtttattttgtcctgggaagcagagatggtttcattggatgcccatggttcaaagtaacagctttatgcataaagagcatcttgaggcctttaccctcagaaagcaggcatagttgcaacagccatgtagtgtgtaatgaagcttcaaagtcttcattacacaagtattatctcaattatctcatccaatcctcacaacaaccctatgagaaaattatctatccccagtcttatcttttagatgaactacattttacagctaactaggttacccaaattcacaaaattagggacttaaagccatgattttctgattctaaagacatgggacttttccattatgcaatattgacttcaataaatatccctctccttttcaatttccttaatgaaagccatcattatacatgtaaatatgtatattgataattacttcaaaaatggaaatgcattgtagttgaaataacaaaaacaagaaaatatctatataagatataggtattataagtagctatcttacctatgatgtaattatttttaaatggacttctggtttagaattttgggctatataggcatacctagttatcttgaacttaaatgcaatttatgaaaaataaataatttttatctttgagagagtcttgtgaaaagaagactcctgaaaagattcctgagaaaatattcatttgttattgttagtgagaatctgggtttaaaaactgcaactatggcaataatgttctcattggaagatgaccacttcggtgaggttatgaccaaattgttatggaattttttaaaaaagttagtaagtgccaatggaagacataacacaatttccaagaaatatatgtaagatcataatatgcagttgtagaaaaaatgatggggtatcaaagaaaaatatttccctggaaaagtgcttgaaaaagaatctactaaaacaataaaacaacaggaaataaggtgaaattggacggagaaaaaattcaacagaattaggtataagacacagcatgggccaatcttatttgacaaggttcaattgacattaacaaaaactggacagaaaaaacagattttatgaagaaatgaacaaagtcataatttagctcagtgcattaagttaatcagttattaagataatcctgctgaggcacttgaatctttatttccttacccaatggttcagagccacaagaaccctagttcaaatgcttgtgcagttgatctggttaatcaactaattctaagactgatcaactttgaaggaaaatcatttgaggaagattattatgcccagttggaagtaactggactaaggaactgaaagctgtacatctttctgtctgtgtgatagaacctgcacccatgcagttgtccaaaaactatactttctagttcttttcagttaaaaaataataataaaattgatgaatggattccaacagagggcccttctctgccctaaaacatattgacacatttactcatatttctgtttgagggtttaaagcagctcaaagtttgtaacttcctgtgtttgtctgcgcccttcctcctaaatacgcaagggcctttaggaccaaaaactcctcagcctccttgtcagattctacgagaaagaaatgcttttttgttttttttttttgttttttgtttactgaagattacagaaaggagagtgttagatggtctatcttctaccttgcaggcctgaattttttttttttttttttaagacaggatcttattctgtcttgctgctcaggacagattgcagtgttgcaatcatagctcactgcagccttggtcttctgggctcaagtgatcttcctgcctcaagcttcctagagcactgggattacaggcgtgagccactacacccagcccaggccttcagacttttgtgttctcttccagctcagctctttccaaaagccagtaaccccatgcaggttggtcctcgctgtgagattctttctgagtagtctactctctgtcccttgtcatcacagtattcttgcttttgagggaataggccctaccagaccagtctgaatctcctgaaatgttggtgaataaaattttgttctgataccacagtgtaagtaaacaaacaaacaaacaaaaagcagtcatcatttccaatttttctagaagatctcaagttgtttttcatgcatatggtgagagaacaagttttttgtttttcttttatcttaaaactgtatatgcttgtgctacccagaacacggtattatgcagtttaagagattctttacatgcttggcgcggtcaaacatcaatagttctaccttgatagactttcaagtctggaaaaagcttaatgaagttaggagtctttatggcctcatttttttcttttcaactgttagtttaggttccaggggtatgtgtgcagggtttgttacatgagtaaacatgtatggggtttggtgtacagataattttgtcatccaggaatcagcataacacccgataggtagtttttcagttctccccttccttcaaacttttaccctcaaataggccctaatgtctgttgttcccttctttgtgtccatgtgtgctcaatgtttagcttccactttattttattttactttgccaaagctacagaacataagaaagtagtctgggaaacttcttatagtgaaaggatatgtatacttgtcttttgggagatacaaaaaaaaaaaagggggtgaacagggcagaatttttccaattcttgggagagggaaaactccaagagataagagtgggtggaggtaattttaaaaagagaagaaacgttgattgagatttgaaggtttgctggatggcagaaaaggatagcatgaaaccccggctttggccacagatgtgtctgaaaatgttgtaggactgtctccttagttcagccaaaaaccaggttcttgtcacaggaccaggaaaagattaggctcacagacactttgaagggtggggaggatggagtttgttgggagaaaaggaaaaaggaaaaataacacagcaaagtgagatggggtcctgctaacaggctcttcacctcacctgttgaatcccaggttaccacccaggaacaggagaggccaggctcctttccccctgcaaacagcaggaacttcccaaggtttcaccccatcctgccagtcagtgcgccggctggttggagattctctggggagcccttttttacttggctgtctccgaaccttaatacttgcctgacatgctgccagatttcttgaaagacacgctgcaaacttaagttttttatttgttgacatagggtttagaaggaagtataaaacacaaagagtgatggaggggacagaacaatggagaaccactttgaacctagacatggagttggcaaactttttctgtgaaggaccagctagtaaatatttacatgatttctgtagcaactactcaaccctacctttatagcatgaaagtagccgtagccaatacataaatgattggtccctgctgggattcaatgtaactattcacaaaagtagggagtaggcagatttgttctgagggtggcggtttttgctccgtctggactgttttcccagatttctttgcattagcgtatttactacttctcctgttagcaagtcttgactgaatcagcaaataaataacataagattcttttccagttttactctttcttttcctataatgtttacaatagaatagtgcatgaataattttgattccaccactacctccatttgcatcacactatttcatttttcttattattctcagtgtaatagaatgcatcacagaatgatcaccttgagattgtcaaggtgtcactatttctaaaaattcaaagtacgaaaggggtctttaaggaaaggcacctgggataagaggcacatagttacttaaggaacaaggggagctaataaacatcctatgtataggtaaataaagtgagtaaagtacaatattacttttacttttcaagaatcaaacagcttacttgaaataaaataaagggcaaaatgtctctaaatgtggaaaataagtatctggaaactaaataatttaattctaatttacaaaaagaaatactgtgatacagaaaagcactaaaaatacctagtgattgatagaaaaagcagaatacattaaacatcaaaataaattatgtggcagtattgtgatgattcatcagggcaaacaagtggatacaggtttctgagttttaatcaaggaattcaattttgttcaaccatatcttttgagacaacaataaagctaaagtggggcaggttcatttcagatgagaaaatatttaaatgaatcatttaagaaatgattaatattattatatatcagtgaaaattatttctgaaacttttagtaggatacatcttttgaatatgtgcatatatttgggagattctgaactgaatcaaggtaatagttttcccttttccttgattacttactctagaaataagaatactaccggaaaacatttgccctatatctaatgtaatttgccatacctcaattttagattgtatttattcttttaaaatttttactttattcttattttaaaatttattttattttattttttatttttttcaagatgggctctcactctgtcttctcggctggagtgtaatggcccaattatgactcactgtagcctctacctcctgggctcaaggggtgttaccatctcagcctcccaattggctcagactacaggtatgcactaccgtgcccagcccagctgattttccgggtttgtttgtttgtttgtttgtttgtttgtttgtttttgagacggggtcttgctctgttgcctaggttggtcttgaactcctgcactcaactgatcctcctacctcagcctcccaaagtgctgagattacaggcatgtgccaccacatccgactcatcttaaattgtatttattcttaaattattttctttttttctcaaggtagaatttttcctatatgctgagataaagtctgagtggaagttgctcttgtatttattcatatagctattactttaatactttaaaaatattttagatttatattaagtaatatattcaatttggtcaacatgttttatctctaagccttggcaatgtagcaatatgtttttaaaaatactgtttgtaaaatgtattaaagtttccaaattaagaatgaaaacatggttttataatagcctttgctggctgttggcttctagttttcttttaaaggtataatgattcaagttcatagaattccttcaatttatatgcaaagttctccttaattgcattttcttataggagtatactatttgtttattaagtaaaaattttcaattcaggaattgcaatcctttcttattgaaaatctgtactttttcagattaagaaaaaagactcacatggttgatggtactaaatgcttcttcattaactactctctgtctgctcactactccttgcctcattactgaatcatgatcatttctcccccttagataaaagcttctctgttttatcagcatatccctctgttttcttatctttgccagttcttttctacaggcccctggggccagtccaccgcatctgctatatattaatttcccctaatttgctgctgcatgtctcattctattgggaccaatctaatcttagatttaatttttttctcagacatttcttcttccttcttatatacccagtatgtaacagcatccttggcattcctttcctgttcaggctgcttctctatcaattccctgagaatcttggaactgagaggcaggctcagaatactccttgatctgcactatcctactctccttttcctcaataacttaaggacttggtttagtcttcctcaatggctttctcttgccattgtatttagagacttagtactcatattgatgaccattgatgaccctgctctctcatggtttccacctcctaaaagctgatggtggttgtctctattaagcttcagccaatctgagcttcctatcattgtgattacactctcattacttgaacatattccatatccgagaactataactcagcatactttctgtgaacacaacatcttactccaacttccataatgaacttctcatttatctcctcccccgagtccttctgtccttctcatatgccctcttacatcttattcattctggtttgcctgcttaaatgttcagcttgtactccagggacagccatttcaaaagtacatttgtaaccactttagaatctattgtccctttgatcttctaccaattttctttcatctttccattgccctagttattctcctgtgtcttttgtaatgggcaaacaaattctgttaacgtgggctatggacccaaatgagtgctgcctgactaactctatagcaaattcttgcagttttacagcacttgggatctagccacttttcccatctgtagttgactcattcactaatgtggtccaggatttttcctttcatggcacacatagaaactatttttatgcgactttttacctatgaatgaggccaaaatacttgccttgtttacactaatggacattgcaaatacttagtgagataatgtgtgttaaaatacagttttacatctataaggccctaatattataatcattccataggcacatctcatgctttaccacctctgtgtcttattcattctgatctctgcctgtgatatccctcctcaacttttaagacttagcttaaatactactttcttctgtgttacctctatccactcagcacctggcctgttcctgttggccttggtaaccagaaatctttatttttaataatcctgactatataagattctatgatcctggtatcccaggtagtacttagtccactgctctgtatctagttaggcagaataaatttatgaggcaccaaattaaattgaatgataaattttgcaaatttagaagtatactcctgatagcaaaggtttgagtgagtttatgggttattcacaggacttttatgaatttttcatcctttttatctatgcagctcatcagttcattattacacttcattataaagaatacactccttattacgacgataataaaatgattttttttgttacaatgaatagatttaaagtgtcattgattcctctcctcttcagtgatagtttttttatacactaagttttatacactaagaaccttatggttttagtagcataaaattgtcatcttgtaaaagagcttgattacatcagatagtcaagctcttgctagtaagacatgtttctgaacaagccctcagaaaggaaaatatattgatagatcactttaccatcacctgtttgaaagaataacttcaaactattcttgaatattgaaaaatatattttcaatattgcctttaaaaatcctgtactttgaaggataactggattaaatgccaaaacaattttcaaaacactctatacacatggctttgtcgtattttttttgtgagagaatttatggaaatactacccatggcttactagagccacctcaatcaccgtttctttttgctttgactatgacatattgagtgtggaaaatactttgtacgtgtatatataatatatattttatgtgtgtatatatgcttatatatttatatattatatgtttatatatatatgtatacatttttacatatttatatattatatatattttatatgtgtgtatatattatgtttgtgtatatatatattacagtagccctttactttttttcttttctcaacacagctgaaggatataaacatttactttaataataatagctttctaaagcattaatatctcattgcagtgggaaaaggccaagaatcttagaagcagaatcttagagacttggaggggaattgttggaaaaaggtacctaaggtttataaatatgtcctcctaggaagttttgcctctttccacaaatttccatggggaaccttaagttataaatttgatttcttctcaggcatttgatagaatctgacccagtaattctaagtctacatatttgccctttggataacatcggtttcaaaaatagagagctctatatttgctttcttcatatatttagaacaacagttctctcaggaattttgattataaatagtttaaatagataaatgggaagctgtaatcagccagttattggttacctaacatattaggatatttatgacatatgtagaaatgtaagttttactgatttctggaaatatatagatttctatgtatgtcagggaacattagaaggagtgtagctcccatgtagttcagttctgacatctttacaatatctctcacagattgatttttatttatgaccatcttgaactattgatgagacattatgtacttcaaagtccattattttttggggcaattcatattgttagaaaatccttccctaaatccgtaaattgacatttggccaaatagaactaatgtcaatttcatgtgaatagctgtacttaagatttgtaacttaagccattctatagtgtagttaccagaccttttgtcatcccgtctccttccctgattctcttgtcattgtcccaattacaaatgtacttcttagaagtgaactcaatcatgtagcacagagtatgagcatgaccataatgtgagcattactttatatgctataattcaggcttgaattaacatgtaggcagccagatcaagcattggcttgttgaatttttgattaattagaggcatcaatctttcataatatgtactgttttagagttagtctacctaacacaggatattttgttgtttttatgttttacataggttttcctcaaatttcttaacaagagtttggacagtgatatctttatttccaaaatccatgtattatacatatgttaggatatttgtcaaatatacttttgatttcaaacattaaactgtccatatatctgagcaccaaaataagttgataaatatattttgcaagtacatttaagtctgagatctgaaacaaagtgtaagaagttatttatgggggaaaaatctaaatatcacacatatttagtcaatcaaattgtgcaaattattttcccaaatttgaactaaccataagttagtgggcagtaaagcgattatagggaaatcagttcatttctctgggcctcagtttctttatttatataatcatatgattggacacaaaatttatatattaatgaaatacttgcaacatatatttagtcatatatatggaattctaacaaaaatgatgtttctggttgatgagccattttgaagcatgagaatgaaaggaaagaagtgggttttattgacagcaacaaaaagattggcaagaagtcacagatatagcctgagagaaaggaacagacacactgtgtttcttccaaacacagaaacacacatcaatttaaaatacaagcattagaactaaagtccatagcttggactttgggtagaagcatatggctagaaagtcctttataatctcaaggagctctaagttttagaaaaacaattatcatacaagaaagattacatcatccatttagtaatgaaaagaagactagttcattacattatcgttcatgggatatttgaacactattaaaagataaaaagaaagcagagaatatactggaaagaaatacatccattaccattatgtttagttttcttatgagtttatgaggaaaatctttaaatattagtaaagaaaattgacaaaagacatgaagagaaataattcacatatcaagaaatacaaattctcttaaggaataaaaatggtattgatttaccaaaattttaacctcatttgtaatcaaataaatgtcaataacaaaagtaaaatatttaactgccaaaatattaacaagtatctctctcatttgtaagaatataaagtgatttttatctcttatttcatattattctgaatttttaatttttaaaaacaactgcattactttatagctgaaatcgacaccaaacataatttagctccaggcttcctgaaagccaggccaatgtgaagcactcagcagtatgtataatgtaggctgaggcacctgtaacaaaagacagattaagaagggaaaaacatgctaatttatttaatataaattttacacaacaagggaggctttggaaatgaaaacacaaggaaacaagtaaacttgtgtactttcatgcttaggtttgatgaagaagtggatagttgtgaattatgattggacaaagagagtatgatctaatgataataaactggtggaatttagcaaattctgttgattcagattctcctttgtgtctctgtgtctccagagtattctgcatagtattctttgacactgtatttaaaatctatatagcttggtgttgatggtagaatactttcaatttgtttgttaatcaaataatactttccagatatttcagatgcctttaatattttgacacacaaagggagaaatgtctgatgggggactttgtacgtgattttcttggagtgtagagacgattaattcaaagataaagcattgggaaaaagctggaaaatgggaaaattctccgatttggaaaaagctaaagaaaattagagaacatcatgacttgttcactctttgttcattttttgttctttataaattattctagtaagtttattaatcaatacattgactacttgactccaaaatattacggagtctgttgaaagtcattctgcaactcagggaaattatgtaactgccctcaaggttactagttcttagacttctatcatagatagcaagagaaatctaggaaatcattcacaaatcacatatcacatccagatggcttgaaattttgtagctctagtaataatagatttaattagtaataatagatttaataatagacagtgactataaacaagacaagagccatcataggtttttttaaatgaatccacagtaagttgaggagtgaaccttattacaatattgtactatgttattgtaacattgatctctttgttactaagttattgaatctttggagtttaagaaatatggcagattgaaagtcactgaacattccagaaatttggaagtctcaagacctcctcaaggatgtgattctgtaccagggacaattttaatatcagctttagaacttctggtccagaccccagctggcttaatagctgatgtacaccagagaacatgtattttgcaagtaactggttcccttgagtgtggcagtaactactcggtgtttcctgttgcctacataattgagttcatcctttttatcctgctatttaatgtactttgatatggtgtaacaaaaatacccttccaatcccccaaagaaagaaaatgacatgaaggaaaaagaaaaaaggaataaaatagagaagtaaagaaaagaaggaaaaaggtaggagagaggaagaaatggtaggggaagaaactgagggagtagagtaagagatttattttttgtgtgtgtttagctctggcagttattactggtgtgatatttggtgaaacattaaatatccctgggcttcagtttcctcagagtaaaactggaggattctatttgataaactttaacatagctttcaggtcttttgattttgatcccatgacaatgtttgaatctcctttcccgctctattttttcatgtgttctatacttcagccagatccctttacttaacagtctctaaatcattcttcatcctgtttagattaatcgttgcacagtcttctcaaactccttatcctgcggaaattctacttaatctttatgtttgagctcagtcgtcattccatagcctccttgatttctgatgtggacttaatctttatgtttgagctcaattgtcattccgtagcctccttgatttctgatgtggaaattagtttctcttccctatgagatgctatatagtactccttgctttatatctctcttatagctcttaacattctattatcaattattatttgtatttaatatctttgaagacaggggccgtatggttatcattcttatgcctttcatagctactagcagtcatttattatattaggcagtcaataaattggttgaataaaactagactaattatgtggaatttattttgagatatttgtttctgttgtcttatggaaaattaaccatacaaaagccaccattcatgaagacagcatggaatggtagaaaaaaagtaaaaggtaaaatctggatttgcaccccatttttaaatttaattattttgtgaacctgaacaaattactaacttttctgagagcccattatttatctctgagggggggggggggtgccaaatacctcccacttttgttttttaagaaaggtgaaataatatatttaatgtgactggccagaagatgtgcctgccaaagtcagtttccttttcatcactcttttagtgaaagttagagactttattttgtgctacttattttatattatttcactttcctatggagacactttggatatccaacgttaaggtatattcacacctattcgagggtaaaacagtattcactagtactaaaactaatagccaatactttctcccaataaatggctttcttttcattatggctttaaatatttgtattaacttaaaatcatgctatgtatatatttaatacctttctattaatcaattcacaaaacatggaggacatgtttcttatgaaagtgacacaaaggctaaaatagtattttcaataacatacatagaagcagagcatatgggtatctaagagaagcatacggatctccatatgttaaacactttcttcaagaaacatggctatagtattgataatcagcatagtatggttccttgatttaattaaagattagagtcctttatgtagcaatagtaaaaaccctaataacactttaagaataacttacccagtggttctcaagcttggctgcatatgaaaatcatgggggaactttaaaagataataatgcctgaggtttcacccaaatacatcgctgtttaattgctctgtgcttgcagtgtatgaaatttttgtgtttttttttcattttttaaaaagttctccagcatgtagccaggcttgagaaatattgctctcaaaataccaaataaggcactgctttcaagttcctccagaactgcttgacactatgacattttattttcctaaaaaggtggcaatgatacatacaaagatatgtttgctcaatgcttaagtcagtcttaggcatcaaaaattgaagtgccttcaagcaaaaactaaataatgcaaagtctgtttttattggagagcaagttagggggattctatctcaatgtgtttattgctttcttgtgttttaaaaaaaacccaacaacgacagtattacatttctaaagtacaccaaaatgggttaagggagtagtgaagcattgagaatactatctgaatgttgtccatagaaatattccaccatttaatagtctcagtctctacaagtaatcaaaattcaaaccatgtgattaatggcaatacaataaaatggcagttttattttttcagtaactttgcatctttcagttactataaaaatgcagttttctgtagcatgatagttctaaaaaaaatcctttcttctaaggatattgcttgtgaaaatgatgtactgactctctacatattaaagttttcaaaatggaattccctccctacatttcagtgatctccaatagataatgttattattcaactgtatcctgctattaagatcagaataagaaatagcagcttcagatttcccatcctttttttttgtttctgttccgttcccagtagtttctttttttcattcatcttcagatttatccatccctggcaatttcaagctagaggaaacaaattaagaaaaaaattaattgactttatttgctttaatgctgccagcctatattatctgctttcttaaatgagtttggaattgccagctttgagggtattacactacattttgggttgctgccagcatatcctgaacaaatatatttatatcaaagctaagctgcttaaatattcatgttatgctcttattacggtttagagaaatgtgaaaccatttaagatttgcagacgtgttacatggccaaaaaatgtgcttgaactgtcagaaatatactttaaattgatagcgctaacctagtttaataaggaaaagtttccaccgtcttattagtagtgatacatttaaattcttaacttttttgtgatttttcagtcactagggcaatatgaatgtaaccttttcttgaaatgtcaattggaaatgaccccaggatgtaacgttatgaagtatgtagactatcagatttcatgtgctttatgtctgtaccgtgattttgtaagcacccttttatcacatatacaatatattttgttatattatttttaacgcctacttcattggcatgtttcttcaaaatgtagaattgctaaattctatataaaacatgctcttaatttccagtgacagactttgaggattcccaattgtttgaacaaagcataagatataaaaaagggaataacccagaaaagcccaacaccaataaccgttacacgaaacaaaggaagtaaagaaggagaagctgaattcacaccctttgaagaagggggacaattgagttattcctaccgtagactgaaggacgaaggccgattttcctgttgcctcctctctttcctgttttctttttcttcctccttagttttctttgattggtatcatcatcaactgaccatttggagcatctgattttgtataaaacaagtttgttctttttactttccgtcaagacaaataaactattcagaatgtttaaattccagaattccaaaagctctttgtttataatcatagattctagtgatactagaatgatctatgatttatggcatggagcattttcaaagcagtctgagcaattcaatataaatttatgagataccagtgagaattgccactgtttcactcctgcccctcccatgagtatagacaaacatgctagaccttcccgtcaggggaagaacccattaagccagttcagcggtctcaagtcacaggtgctgttttatgcccttcagttaaatgctcagatttcaacataggagattaactggttatagcaataggtccagccatgagactgcttgtcctatactgagattttttttatttctaaaactaaacctttggtcagtccaaaccattagcttttactgaattctgctctatatgttgtagtgtttgagaaaagttccaatagctttctctgtgggaaaccataaagttgttttttgcttcagtgaggcataaatcttactggggagagcctgcgaggattacatgagcattggtttcagtgctctgctaagagaaggaacttaagcttattggtataagcctggtagattttcaagattttcagacattttccatgaacatttacaaaattcacatacccaagtattcacaaattttgtatgcagcaatgtattacctttaacagtgttgtttctttaatgttttaaaaaacataatcctgaattttaccagcagtttgaaataatttttaagactcaataatttataaaatcttctacattttacctactggatttggttataacaggacgaaaactattattttggggagtctgtatgtataagggtagtgggtcatggggattagtgggcatggcaggctgaggcagggaaaggaaactgactttctggctaagtggactaatttgtttttgctacagcattttgtgcatataaaagagaagaaattaaaagtgggtaatgtgttttgaaatgttggttctatttttttcttatgagtttagcaatatgttgtatattgagtctcctctctccaagcaaaatgccataattcaaaacaatgcttcttaagtgactagagtgggaagagggaaaaattcttctaaggatattggggttgggagtgggatgataacctttttaaacttattttctagtttcctcaattctttgctgaattgttcctatcaccctgcttctagaatgccatggagcaggctacattattaatagtgttataggagccatgccttaaaatcattagacctaggttagaaatatacttcccaagttaatttaaaaaaaaaagtgactatttcggggagtccttataaattgagtgtccagtaatttttctgtatttttatttagtggtacatttacttgggtaatataggtagataacggtttgatttgggaagcatcatatgaacatgacataaaaccagattaatgttgagtctctatttaaatatgttacagatttagtaatcaggtttagtaggagagaaaataacggtatttatgactcaatgagataacttgttttatggctgaatgggatctgattgtactatagtatctccgatggtagatgtcatcagaaccagaattacatttccataagcacaagttctgcttattatataattgaattaaacagctagtagtttttccagaattgagaggtaaaaactcaaaaagctaacatggcatgtttgattcatgaacttgatctggaacacaaaaagcttctaataatgggcaggtcttgggggtcctggttacctttaagttgttggacattagcaggaattgggacagatttttttttttttttaaaaaaagagaaggatgctgaaaggcatatgtgcatgtaagaaaactctaatggaaaacttcactaacattataattttggtgacatatggccttgaaataataagaaaaaatattatgaagtcctaggacccagaaattaggtctgaaatgcttaagtgaaatgcagaattaggtactcacacattttcaatttgaggaggaatattttccttgggatgatttacattcaatgttgcttggctgaatattgtttatctaggaagctacttggaggtagggagtgaggagaggagggccatggtgtccactagtgagagttgtcctgaaaatcaaattctgaaaaggagagtagtaatttagtaaaacaaccagtaattatctgaaataaacattttctatatccattgtacctacaaaataatacatggcacataagtaaatgctcaaaaagttttgttgaaagaattaaaataacattattcaactgaacttcaaatgtgtatttggtatatgtgcaggtatgcttttgtgtgtgaatacaagcttaatttggaaaaaaaaaaccatagagtttaaaaaagaatgtaagctatgttctttagttcctattttatacatcttggattattgcattaagacttttcatttgtagctgtgtgcatttttatctaaatattaagagttttaaatattttcagacttattttagttaggcaagaaaaagtatgattttcctagatagagtcatatcaagacaagcaatactagaggacaaatctagagtacagataattatttctggattctttgggaggctgcctaaacagagtgaagttagttgctcaacttaagtatgccatagcaaaaagtcttattttgtttagttgaatcattggattgattcctaaacaattctaaaaggaacaccatggccttttgcatatatgcttatgcttaggcaaagctatgactataagtaaaaatgacatgcttgttaagctgcagatatgtaactgtcagtaatcaagccattgcataggaatttatgaacaaattcagtgtgtctgtttttccctgtgtacataattttaatatcaacatcaatattataaactaggtaattgtaagagggtatggtaaacttggtgaggaataagcatatgttgataaatttgcacctctcttgaggtcacttattgattacaaagcttgttatctttcatgtgcatttagtggtgtaattgcttttgaaaattatgacaggatgataccaaatgcaaattaatagtatggcacttgacatacctgagatttcagcaattttttttcacatccgtatgtaatctttattggccaagatagtctatccacattttgttctgatggaatatttaatttttttcatggctaaacctgctttaattatcattttgactttttcacttctaaaaataaatgttcatttttgctctctaaatataatctatagcctattgaaattatacttatttgctaaaagctgtagtgggtcctttcatcttcttttattgaatttaggattttaactacattaaaatttacagttttggtgcttcacagtttacttctttgaattttctttcaaacaaggttgacctggaattagaaattacaagtagccatgcttgattaaacagtcactccctagatgccacagaatcctgtggctactactctgaaagcaaaggtaaggatcattcaatgtgtcaggaaaatattttacagtagatttaaaaccattaaatctttccataataattttatttaaaatgataaaatattatatttagacttggaaagtaaattactttaaaaagcagaaagcaaaagcacttaagccatcatttttaaagacttgttgaaaaataagtattctcatgaaaacacactgtgcatatttgaaaaatattatgagatagatttgtgttctgtaagtagtagatagtttattattgctatgatgctggattaaaatatttttgttgcatattatatatattttttccttctgagaagggatcttttttttttaaaggacatttccagaaaaatcctcacattaaaaaagtattatccatattattattttaagaattttatgcaactgacttatttcatcacaatatgtttgtgaaaagccatgaaccaatctctttttgaccagtttgttagatatttctttgatgggaatacacattcttttaatttagtgctccaaatatttttcaaattttggtatacagaaattaatcagattcccatggcctgcttagataaactgaaggagtctggctgctggcccagggctggggctgtcccagcctcctgcagtgcagcctccaatggtgcactgattgagaggctttgatgtaactgacattcactgactcagtctgtgttctaggcactgcagatacaaaactccatctggggtcaggatcttttccatattatctgcctggcacaaaagagtgctggcaaacccagtccacctctgctagacaatcgtatctggtactaggacggcagcctcttcagcaagaagggggtacattggccaattcctatgaattgggctcctcgtgaagaactcatttatccacatggagtaggtattaccatgtcaaatttttctcaaaacataggacctctcatttcatgaggccaaagatttcttgattttaaactgacttttaatccatgagaatatggcttgtattaatttaaaaagtaaaagtgttcaaactgtgattgaatcttttttgtgattatgaccgcaaacttctgtgacttcaatattttcagaaaccacaaaaatttgatgcatccaaatttttgttttgaaaaaagttggagtaataatgggggaaaaattctctgctgctttctgcttctgtgttattcaggcgctaaagctaaggtccccagaacaccatttttttttttaatgtggttttcttgaccagaagcagaaagtgtcagctcacatgtaatgaaaactatccatgcatgatttctagcctaatttggcagattccaaaggtcctttgaaaggcagctgacatttctgatgattacctaaattgaattgaacctttgaatgttgtcattttaaaacatgttagactcagtccaaagacaaaaaagagtaatagccatatattacaatttctgatgtgaagaaaccatttagtcttccatttataaggcacaaatatatttgccatgcatcttaaggaaatccatcataatatactcttactgagattgctttcccagtctttgttagcatattcacagtatagttctagtcatagacagaagctacgcatttttttagaaggtacagcttacttggaaatggtagtggtgattcttcctagaggttgaccttaactatgcaaacaaactaacaaataaatgaacaaagaaaaaaaaccctcaactttataggaagttctaggttaacattttttcaacaatattggaccattcatggtggctaacgaatgagtaccaaaatataaaggctcactctagagtgtcctcatgcatacctcattttattgtactctgctctggaccatagaaattacacatctcttgctttttttttttttagacagagttcgactcttgttgcccaggctggagtgcaatggcactctgcctcccgggttcaagcgattctcctgcctcagcttctcaagtagctgggattacaggcgcccaccaccacgcccagctaattttttgtatttgcagtagagacagggtttcaccactttggtcaggctggtctcgaacttccaatcttaggtggtctgcccacctcggcctctcgatgtgctgggattataggcatgagccaccgtgcccggccgcacatctgttgctcttatccacaacttccaaattctgcctctgcttctcctgttactcccttttttctctccccagtgtctagttgtgccacgacagtgtcaaagccacagttgagtatcacctcccttgtgaaaccttttctggcttttccccagcttttcactcctcaaatctctcaagcagtgtgtcattgtattttctctggggccatttaggtctgtttacacaaggacaaatgttcaaaggagaaaaagtatccctctagagtaacttttataaatctaagagtcagtgtaccacattctgataaaattatatagatactaggtgttatttctgaattgggaagtttgtttcttcttaaatagatgagtagaccttaaaataaacttgtattggtaatgtaacacaagttgaaaatctaatttgtggcaacatgcattcttatcattaacaggaactgttgcaaattggctagaatagtcctttgcagtttggattacttttctattatagtaagagtgatacagcacattaacactttggcttattttgaatagatagatatttgcaacctcatcctggagaaatttgcattcaatctttgaacagtagggggttatctccatatagagaatcttcaattttcactatgcatttccttaattttctctggaaggacacctgcaagaattaaacatgggctctctaacatcaaattttgtgtccttagaagcctgagggaaagcagaggacattctcaatcagtcattttttttctttgatgaaaagtcatctgtcttttaaattttggtttaataacaaattgactccttataatgaaatttatgtaggtggtcattttgtgatgaaagttagaggtaaaatataagtattttaacagcatacttttagtatcaatgtgtctgttattatcgtagacatcaccaattagaaaggaagataacaggatgatacactgtggagataaagtgataattcttttaatattctttaattaaaacagaagagtcaactaatttcctagttgctaaatactggagatgaaaccatgtggacatttacaaatgttgcttctgggtgcacatgttagttttcttttgctgatataacaattactgcaacttaatggtttaaaacaacacaaatttatcttgctgttctgtaggtcagaagttgggtacaggtctcacaggggtaaaattaaggtataatcaggactgcattcctttgagagactcttggggagataatgttttctgcttattctagttgttagtggcattctgttcatcgtggttgtagtattgatatcctagttacttgttgtttgcagctaaaggttgttccaaggttctagatgccaccacattccttaccttatggcccacttcctctatcttcaaaaccaatagtggccagtctagttctcgcattgcatttctctgattcagccaggaaaagttcttcactcttaaggattcatttgattagatggaactgtccagataatccatgatggtttccacattttcaggcttaactcttgatcacatctgcaatattccttttattatgtaaggtaacatattcacaggttccagggattaagacgtgaacatatttgggaggccatttttctgcctaccccaggctgaaaaaactgagtttaacataagctctccattaccagcactcattagggattttcaggaaaatatcagttgggttaaattgggataaagaaaagaactgagaaaaactttgttttatacgtcctaaagcccaattcttgccacttctaatagttattctacaaaaccagcatgttggagtgttatattccctgacattcctagctattcttaagacatacgaagctgagaattgattcacaaggctgcctggttttcaatctcagttctgatttacctagtttcggatactttaatgtgatcttggggaatttatgtaacctatctgtgcttaattttgctcaagtgaaatagagacactaatatacctctttcagggtgttaaatgttaatatgttaatgtgttgtttggttagaattattagggcctaacactgtataagagttatatatgattatggtagaactatacattgctactgactgcgccggtgtccctcaatacatatttttctgatatagcaatgtgctccatctgaacatagacccaagcagtttttaaaaattgatgactgaccatggggagtgttataagaaatggttattttaaagttgacagcatgttttctgtttctcaggagaaggttgaattcacttaatagggcagaatgtccctttggttttggagaaaatgtcactgagctttttctttcagcaaaaatagagtcaagatactactctaaaaaagaccaggaagatcttgggggacacaatttctctgttttatagtataaaatgttatttttcttaaaaaaattataggtacaaggacatcttaaaaattagatttcctattagtatcattacacacactgatctgcttttatctgtgctcctgggagttaaagtcaggcctgtgcctgtgtttgtagcaaatttttagagaatgtagcccaagtaaactgcgaatgaagaaatgagagatggtgtgcagaaaagcagggctgctgtccaagggaactggtaacattcagccctgattgctcatcccacatgagataaacagataaacatcccacatggaatcctgaaactgggtcgagggtggggtttagtgaaaggagggaatggatttagatgactgctgagtaggtctgctaggaaagaatacttccatcaaattggaacatctgagttatgctgagaaaaatctttcttatgtaaggaagagatataatgttgaagattcttgtgtttaaaaagcctatatatatttttattgatgcattaaaacaccataaatcaatggttagccatcttaaagatttcagacacttatctttttgacaaatcatctatcaaagtgttttgcttgaaatttgaattaagtggagcaatatgacaaattattttaaacaatattctgctaacattatataatagcatagagacattttacaggcagtgttttagagacagtatccatagtctgcaagacacacaaaaagtatgagttaaaaaaagaaactgtagtctatacctaaatatctttgaataatatttgtttagcacaatattacttaataaatgccttatgattgcaatggttgttattatttctttagagaaatctatggtgaaaaaagtaattttggttttctaatcaagagagttattgactgtcttgatgctagacataatggttggaatgaaaggaactgaaataggaagaatataaattgtatttttattccaatgtgtattttattaacacattgcttgtctttacatcaaactagataactcagttggattgtggcaacatactgcctggtcttttggggaagttcttaaaatcaattttaataaaacgatttaaaatgccataattctttctcagtaaaccactttatgtacacctgtttcctggcagacacctccaagacgttgcctctatccaaggatgactccagggctctaatatctatcacacaggtagaatcagatcattgacacaaggcaaagagactccaacatgcatggaaagtagtatttcccaagatcaattttgaggagcactagtgaacatcgtattggtaattaaaaaaaaaaaaatttcactttgtgtgatggttaatactgagtgtcaactttattggattaaaggatgcaaagtattgttcctgggtatgtctgcgagggtggattataatatattatagatttttccttactgcaagaattccctggtccttcaatgcatagtgtgactagtaaatctccaaaagaaaaaatatataagatacataacctttcctcgaattacttgattacaataccctctatttttgctgcatattgtttttattacttgaaactcacttacatgaagtgtgtatgaataagaataaccaaagagcacatgtggaacagagcagcagcacaggtttcgaagctagcaatcaaggcaactagcaaaacgcagaatatctggaagattagatatcctacacaagctcagcctaaggagagggtccatggctttggcaatgatagcattcagttagtgatgtacagcagaggtgcatgaagcaggttgaagaaagtatgattaataaaactactttctacttcatattttaggcattttttatagtccctcctgagcaggagccaattgcagtggtggaggcataaactttgcctgtcattataagtcactgcattgtgcttcattataatttttaccttttctttttctttcttttttttttttttttttttttttttttttgagacagagtctcactctgtcgccaggctggagtgcagtggcaccatctcggctcgctgcaagctccgcctctcgggttcacgccattctcccgcctcagcctcccgaatagctgggactacaggcactcgccaccatgcctggctaattttgtttttgtatttttagtagagacagggtttcaccgtgttagccaggatggcctcaatctcctgacctcgtgatctgcccgcctcagcctcccaaagtgctgggaatacaggcgtgagccaccgtgcccggccccaaacattcttataaaaaagactttgtggtggatttttcgaggaagaacagcataggccttttaaagggcttatacctggcagagactaagtatatgggggaattgaattagattaatattctttctaagtcaatcttgataacaggactcctgagctcttccttcactattttatcatctgcaccactccctttaatagttccaaaaaatgcaatatggctaacaggataatatctgaaagcgaaggatcttgactttccttggataattttttttgcctgctgactcttaatttttatttatttttaatttatacacataacgggtacaagtatagttgtattacatgaatatatcgtgtaggagtgaagtctgagcttttagtctaaccatcacccaaataatatacattgtacccattaagtaatttctcatctcttccccctcaaaccttcccatccttccaagtctccaatttctattattccacacttgatgtccatgtatatatatcatttagctcccagttacaagtgagaatgtggtatttcaccttctgtttctgagttttttcactggagataatggcctccagtcccatccatgttgctgcaaaaaacatgttttcatttttttaaatggctgaatagtattctgttgtatgtatgttccactttcttaatccaatcacccatgatagacatttaggttaattccatatctttgttattgtggagaacttattatagaagtatgtttttagacctcagatttagagagtctcacccagtagatctgcggtgaaatccagggctctccattcttgttgagctgcctagatgatctgaagttaaaaggcccaggtaccacactgacaagactctcctaaaacctttgcagttgcaaaaatattactcttctagctgagacacatcaagcgggacaccgatgttatttatttaaatcaaggcaatccacatataatgagattccagtcaggtcaagtacttagcagcatttctgagaaagaaaattatctttaatttggagaataagattaagttaattcaagtcttatgggggttgagtgctgttttgactagagggaggcaatgtctaaaagcatgaggtaagattgtcttcccacatgagctgaaaaacaagaacaagaacaacaatcaatcaaagacagttttatttaagtcttggcctccagtcaatgttgttgtcattgacactctaggctgatatggttcacacttattcagttgtttccaaaatatttccttctgtcattgccagtgttgtggcaacgtcaaagtgtttctttctgggtcatggtctcttcaccttgaaactccttaaacttcattcttccactgaaactaaaattatgtgttaatttaattttattcacctccaagaagcacagttatagtttatgaatgcatgagatttgatataatattcattaatataattctattttattttttattatatataaataaaaagctaatatgtaatttgtgacattttcataacttgattaatattgttatattactattgtcaggaacatttcaatgagctgaacagccttacgaatgaccaacactcaataggagattccttgtagcatatatttacttcacaattagtagtcagttgctatgtaaataaaactatttttgcattagtgaaaacatatttgttagctacttcgaaatattaacaacaaagctggcactctttaaaaggctgcttttttctaaaaaaaaaaaaaagctttttctgtgttcacatttgtcatgtagcatatatcgtctttcattcattcttttttcaggatataaataactttctccagatgtcaacctttatggagaggaaaagaggcatcagcaatttcaggcaaccacaaaagctctgatgtattttgaaggagtttgtgtgctttcaagagttttagcaggaaactcctgcagatgatgaaggttgaaatctagaaatgtttgttgttgtctatataaagtatggaattataaacatttactttgtgactgatgagacttaaaggatggatgaattttaaaggtgttcatttattgcttttaaataacttgtaaaaataattttctttcttctgagatttgatctaagcacccgctaatatacatgatagtagctgtcttagatgacacaagaaaatgaaatgtctattcattcatttttggtttggccaatctcataccacaagacatattttatacccttttccagcaacagaagtatgtttttattgtataatttaaagccattttctttgtaaaattttaaaccagttggaaatttgttgaaattgaataatttctggaccagagaaagcactatgaatggggactacatataaataatttaaaagtgaataagagaaaaagccaagaattcatttgcatttttgaataaagccaaactttcatttaattatacagtagtaggctttaaaacatatatttttagtcaagtctgtaaaactgccagatgctaaagtaacatagataagccaattaggaatagtttcattaatataatcagagattttataaaagatacaaagctttcaaggtttggatctgagacaaagtttccagagcctctatgtagcctggtaaaaatgcacaatgattcaaatgcaagcttaaggtaagctaaagtctttcattcttatttttaatagcaaacccagagctcgaccttccattattcaatattgctgttactgctatagtgggaagaaaagagggcaaaaatttgtgttagaacacttacagggaaatattttttacactccgagtgattatattttaagatgtctatctactctattcccaccttcttgtattattcaagttcagcaatacagtgaaacatctacatacaaacttatgctacacttcagttcacatgatgaatacacatatagaacctctataatgaaaagcaatctagattttatttcatttataaatacccagtgtgggctgctttcatagtccttccttattttttttttttttttgaggtttcattttttgcatgcccacgatatatatttttttttaatctggcaaggatgtaggagtgtctctcagggcacgagaagagagccacttcaagtctgccagcactctacccaacagacctatccatcattaaggagatcccagaaagtaggagctatggaactgcctcaggcagagctaatgtgagatagaggaagaaatcacatccagccagatgtcttttgccaagggactgcccagtgggaaggacccacagagcctcttaggaacttgcatgtgtcccacaccagctacacagaggggatcaggtcccaggtagtggtagccaaaaaatcattaaccacccacagaaagaactataacagcaatgaggtaagtggagagggctcatcagttcagttttacttttcattctttcactaatgcttatcttcacatgaaaacattcagttttttaaagagtttatactaggggactagagcagatagaaatctaagtttcaattccagttagctggcatgtctttttatagtatgttttcactttggcatggaccaaaagctttagcagttatccataggaattacaatggaaattccaggcagattttagttaggttaaaaaaaaaaagttgaaaatgttgttctaggccaaggacttgtaaaatgtggatggttgcctcttgtagtttttagtttgcttttgaagtgcttttgaaatagttacaagaaccattcctctttgaaacgggtacgatataggtcacattttcctgtacaactggccttaatggatcctagtataacttaacaagatataggagtttttcttaagccatgataatccagtaaaccacagaatgaagtaatagtttacttaaaatctaatcaagagagaaaacttcaatatatgttataaggttcctcatgataataacaccatgtcttcctatgtactccttccttctacctgccctctcccacttgtcgtaccaacacatatcacttatattcattttgttggacaacagtgaatgcagacccaaaggttgaaaaatgagtatcccagaatactgcttcagttctagtgaagacattgggacagcatccaccagaaatattaaaaaagagtttgggtggtcatctttcagaaaggttgaagggaagattctcagcctgaatgaggagttcactatgtattctttaatatccaccaactagaaaattgtgtggttacaaacccacaatagagaaaacaaggtggtttgttcaaaaatatcagagctaatatttttagagtaactgatctggatcaatgatctaaactattttcacacgtaagatactatttattgtaaaattaaaacatgcaaatgaaaaaaaggaaaaactgttactggcatgcaagagaagacagctacctttcccacactccttaatacaagacccatgctagtgaaaggaaattatttaaaatagacaatatgatttcttttcttctttcttctagaaaatgttaacccactgggcccgtttaaattaatatactgtccaaatagaatttctgttattcctgatgatgaaatgatatcattgatatctaatatttacttgttttctaatgtttaaaatcaatgagttaaacatttgtaaaggcagtttaatttacctgtataaatttagtacatggtgggatataaaactctaactggcctcattcttctccagtcaatgttttaacccttgctgtattgagtattcccttttcttcgtttaataatatcctgaacagattctataactttacagtcactttaattcctaaaagccatccagtttaatatctcacttctattttatcctgtgccatccctgaattgcaggcctgagggaagtggggcgtgatttcatgaagtgatacagatgttggggatttaatcttcatctaaatagtcctctttctttctcttcaagacttgggtcctctctgttgtggaaaagcaagaggtgagggcaggagccctctccacttatgtcatagcttttttagttctttctgttgttggtcaatgattttttggcttctactacctgggagctgattccctctatgtatctggtgtggggcacatacaagttcttaagtggctctgtggggccttcctattggacagtcccttgacaaaagacaactggctggatgtgaaacttccttcaacctttctgaaagatgaccacccaaactcttttcaaatatttccagtgaattttgtcccagtggcttcaccggaactgaagcagtactctggactacccacgttagcagctccacaacccctagtttctgggatctccttaatggtggatagcttttggtagagttctagctgacttgagttggctttctttcactttccctgagagacactcttatattcttgccatggcaattggtgagagggcaagcttctttattgtggcctctgttgcttcagtatgacatctctttccaatttctttgctcagttatgtagtgggagaatcagtaagtttgttgccaaagcagatctccaaatgagaagcgaaatgcctgtctcctcttctgagcgaatccttcaatgtgataatttttctttcttttttcagaagccttctcactaggctgattctgaaaactctctctcttccttcctagctctctccttttatatcctggggatgggggaagagtagggtgatggttcaagccctgcaggaggatcattatactcagactttgtgagtctttgtcctcagtctgtaagctgccaccaatttcttagaaacaggaaatgccctattcactaccctctgacacattgatattataatcaatgctagaaatcatcaatgcaagaaaaatgtagagaaaacaatccatcaaatttttagctaacttttcacaacgaaatagcaaatattctacatggaatgtatacatttgaaaacatttagtggactgcatgatctatagtacaaccatgatgttataaataccagtatgcatttgaggacaagtattaagttgaatataataactcaaatataaatattcttaccttttgatattctttttgtgtcattatgcaaaataataactatggttttatcagttccacattttcacttttttctcttaatgtgtaactaacattttttatttgcatacacatcagaaagagtcctggacttgacatcagaaaatccacattcaaatctaggctcttttcagtgactgcactaataggtgactttggacaattcctttatattctctgaggtttatttagtagccctatctataacgctttggtagattaaacgatctctcatattatacctaatactaatactaatcctaaattttaagaaaatgctattgggtcaataatttagtgtgtttgatcaatgttcgtcacgtgccacctaatttcactatgcccccaatagcctattacttcactatgattggtgtctataactttcatgcagctctgttaaaggagacctttacatgtttttgagttaattattttgactactggaatctaattatttacaggaacaatgataaacatatcttacagctaaacaccagagccatgaaaatgactttaaacatttttataaatactagttaacatgaaactgagatgctttgatttctgttacaatatttatctctttaaaattaaggttgacattgatgtttcactttcatagttatcatttgagaagtccttaaaatatgatacatttatttaaaatctttagtttcttcatctattaactggatgacttaaaaatcattaaacctttaagcatgtatatgttaacaaagcataaacatgtctgtaagttggcaataatttgagagaaatcttcccctttagtatgattctttcattaatagctcaagtttagtttattatgtatatagatgaacagaaaagaggtcaatatattaagcattcaagatgagctatatgttcaataaaagtcatggtgtccataaatttttttcttcattaaagaatgatttttttttgccataccacatttgaaatcttgtatttctcaaaagaacttgggtgtttcatttgtattgctaaacatttttatggttatttaacctggattattcagttatagcatttatttgccatagagcaataatttatctaaaaaacgtgtcattacagtttatcttttatttttttcagatggcatgcttgtgattgaaggtatctgcattttttgtaaagcttctcttttgggatagctttctttttggaaatttccatgccaaaaatattgcattttcaaagatgtcctttcctttatgccttattttttgtttgaatttgttttccctgtagagatataataccgtttgggaaaaggtgctacagattaccttttgttctggtatttttcaaaatatccagagttatttattttgacctcagtatttaatgtggagtcctaagagacacatcatagatttcccatactgaatatatgcatttaaaataaatatattcaaaacatatttacagaaatacaaatgtactgtgtggttgtcttttttctttaaaatcaggaaagcctcccctcccatggcttgaaagatattacatacagcctacatactattcaaaattcatgaagtttgtgaagaccaaagtttatttttaagtgtgtgaataaacaatttccatttcaggttctttttgagtaggcacaatacataattacaattagctgatatgcagccattccttcttgtgatttaaaatcattatgcagtttgttacactgtccgctttcaaagttctttgattgctaattttaaagactgatactcatttcagaataagaaatggtatatattcagaatttggaaagcaacaaattgtatttattttcaatttttttgatttaatagaaacttcagaataatatgaagaggaaaggaaaagaggtttgaaaactaaggtcgagactatttctatatgttcatgtcttgtgtctacttggcccatttgaaggaaattctctcatttctgtatgatttcttatgttgtaagaaataatatatatattattacacctctaatagaggttcaggcagaaaaacaatgaatcctaggttttccttccttccttccttccttccttccttccttctttccttccttctttcctttcttccttccctccctcgctccttccttccttccttgtttatttttttaaagctccttgttttcaatttagaatatggtacactactttaaaaatgtggattaaatgatttattttagctttgaggtagtatttactcattgcttcttttaagaattttagtaatttttagatttttagaacaaatggtacccgagtttttcttatatgtttccctatttaccacatggattttgtaaacaattagagtgtcattctttattattgaacaatataaataatagtcatgtaaaaaattctgttggacttaatttaccaagctagtcttatatgctttctttggtttgacactgtgtattaggaaacacatattttttccagcaactaaaaataaattttaaattgaactaactattccaatgactaattcttatatattatttttcccacttctgagatagcttgtactttttgttccaggaccaaataataactgaatcagttggttttgctgccagttatgggactgtttttgcccatattttcaacgtactgggtgcccttaggtttgtaacacattttatttatctgctctgtcataaagtaaaacacattcatagctttgaggagtagatgtggtgatcgatcactaaatagaaggcacaaaaaatgaacagcagatgttgcttttttgtattttgtgctattttacacattgcaaattaaactcatgtaaaattttgtgggaatattggacagtgcatactctcactgttatatgatttttaaaaaacctgctgcctagttttttctaactcatcagccacatgtctcattacctagttctttttaagcctcctctcccatacactgacctaccaatgaatcccatattaatgctctcagaggaggtggttgtaaactgatttggagtgaagagacagaaaagcagtagcaaaactctcttctgttaggtcaatgtcttcacccaccccaaagaactttgataatttagtgctaaatcaggtgttactattattctatcatttaaaataattgaactgactgagtaaattataataaaatattattgagatgtatatatttaaaatttctttacagttagaaatgtcatattcatttggaactgaagattaaaacagccagggcattatttcttaaactgcacagagtatttaattgtagcttctttgaggaggatcaagatggccaaaatatagggaaaagctttaacacatatttcttacttagtattgtgttgttcattttaattataataaatgttctgaatatttatctgaccaattaaaatatttgacttatgagaagttcaggcttgaatattatactttgcatttttgctttagctttttctagtaatatacaataaaggcactattcctgtaaaatcttatttctatgataatcataatccaaggcccttatcctttatttagtattcatactaagcttatcactgttatatctaagtcagtgaaatgagattccacaggagaaaaatgggagagtggcaggcttttttttgttttttactttgttagctacgcaagtcatagcgtacaaattagatattagatatcttttaaaagtaatgtaattaatttgattacataccatagttcctttttaaaagaagctcacataataatactgttaatcacaatatctagaattatacacttgtagtaaaatttaaaatgtaaatctttacatcagtgattttttttcactcatgcaactgacagatttttcttcttcccatagtcccatccaaccaaacacttgagtgcttcattacatggatcatttgtgcttctgagataaccagaaggtgtaactcttgtgttgatcaattataggagacttcccttgaggccttagaaagagttcttgaaagaaattcttatctgctttccctgactctctctgatgactaataacatatttaaaggctaatatgtgttagaaactgacacacgtttagagaaggtgtattgtgccctagagatctgacacttttcttcactgactgaattctatcatcctcttgtgtctagtaaatttaaaaaagtcaacttggtgagcaagcacatcactgaatttatttttgatattgcaaatattgtatttgtcagagtccaccgaaatgatggataaaaatatatattaacattgtacatgaaatgtattggagaggatgtagtttaaaaggaattaggctaataaaaagttgtttagtacactctaattttcagccagtttaaaagttggatcaaatttaagaaatgtatcaattataaagagctattttttcactttaatgtctttctctttattgaaaacttgtttctttttttttgtgtgtgtctgttttgtttctgtatctgctagacttcagtgttgcactttttgaagagctcagtgtaaactgcaactcttttttcataatcaaaaggaagaaaaataagttattcaataatcttatgtttatatatagtactattgggtagcatacgaaatgtcttaatgacataaagtttatacagcctcagaatttaaatctaaaaaaggcgatatttgtgtggctgagtggaatgtaagaagatatatcactgatacctactaaaacatacaaaaattttataggttgtacagctcaacagtagaagagtagttgaatattagaggagcattataaaggataaatacttttagatgctaggtaaatatatacaaaagagccaaggtaataccccatttgatatgcttaatctgggaaaattttgtggaaggacaaaatggatatgagtatgtcaaaaactgaaacatttcaaattttgttttgttttagtgaggcattgacaaattttaattaagaatgttgtcccatctttttcttttatttatcaaatgcacaactaatctcaggaataccatatgatgaatttagtatataactgtaaatggattcagctactgtgtgttctctagtacaatcagattgaactatttggagaacaagcagttatctatgtggctgtattgtcttcacacatcttccctatgaaatgtttcactactagagaaatatttctttctccaccaatctattatttttacttttatttttattcatttttggaggaaaagatgtgaaaaatgcacatattctcaagataagaagccagctctttaaggagagttcattggtgggaacttttcaaacggacagctagctgagaacaagttgatagacagtgtattggagtaattaaagcaaaaggctttggagtttatgagcatcataagtgtatgattttaggtttttttcccatttataaaatgtgaataattatagtacctactgtataggattgttgggaaaaactcattaaaaagcttggcacgtagaaagatttcactgaattttacctatatgataattatatttttgtagggtaaagaaggaaagaaaatgtttaacttttgaggttcattttgatggcctattaaaaatcatatgttctgcctcactggttaacccactgagatgaccacatgttaggcatgtactattccatgcacactatgttcaaccaagtgatgtcaagctaagcactatgaattaatttcttgcaatagttcaggaagagaaagcagtgggatcttgggttagcatccaaggcgcagtagcatggccaacctaaaagaacctatactattaaaatattcgagtcttaagcaatggtttaccataccagagtagcaaactatggttaatttaaatattaattgtagagattttaaagttttgtgcatttttaaactctctatcgcctaaagtaccctaagattctacctagtttatgtttttatatatttaagaaactgtataaaataaagtaaaactagagggtctgtgaaattgtatttctttaagtgggttgcatacagtccttaagttttaaaagatacctcaagacatggaacatacacttacaggggcagttttgggtagtatgcccagaacaatgtttaagtatcactcatacctgggctctgagttaaggaaaaggggttagtatgttggtgttagggagaagagcagcaagacatcatcagaacggtaagggatattgacaggtcaatgttttatttttcagaatttgcccacaatggcccttcttgagagcttagcccaccaaacaatttgtcaaattatgtttcttatccattttgatctcccttcctctgtagctgttctttgattgggtggctacgatgaaacatgggagtcagggcagaattcaagcaagttggctacttttcagtccattctgttggcaagatgtggatcttaaccatatggtgaggcagggtacttacgttcattctagaggtttattcatatctgcctgctgcaggaaattagcactgttcacacttgtttagccttaataaaaatctttttagctgaagcacagggataaggtcaccatctgccacatagaaatgccaatatcaaatgagcaacagaagggaggtatgtttcattcttagagacttttagaaagaacttcaaatagattaagcactaattgattcccctctttactagtttagactgtaatttacatttatattgtgaattgcatcataatagcagtgaaatctgtcagtatgtcctgcttgccattcttagaaatagcactagaggtagcttttaaaaatatgaatgcctttaagctgaaacatatactgtctgtgccagacactacatgaaacttaagtttagatggctcagtgagtatctttgagtttttatgaaaaggctgatagattatggactaccaattacctttaccaaaaagtacatttttgaataagagtatataatgttaatggaatttatgattaattaatttattaacaattaggaaaagttaatgaatacaatgtttaatcctgaattttagcatgattaggtttttttgagtccttgaaaattattaggtacttcaaaaatctggttctaccaacagaattttagtttcgaaaagacaaacaaaatcttaaaataacactttattgttagatcttcgggtcctgtgtattatagtgaaggtttactttcctttgttttctatgttctacaaacaaatcataattaatgacaactagattaagaaattaaaagaatttaaaatggttataaatataaccagatgtggaaactttttataagttacattatatacaaaggaacaaacttgttcttttacttctgttttggtttttttttttttttttttttaattgagatggagtctcactcggttgcccaagctggcgtgcagtggcgcgatctcagctcactgcaacctctgcctcccgggttcatgccattctcctgactcagcctcccgagtagctgggactacaggcgcctgccaccacacctggctaatattttttttttcttttgtatttttagtaaagacggggtttcaccgtgttagccaggatggtctcgatctcctgacctcgtgatccgctcaccttggcctcccaaagtgcagtagtgttaaaaattgaggcctgagactaattttaatgaatttaacatccattttgcctcattccaccatctttacattctttggtcatatttagccttttgtatgttatttgtggcagcatacccttaattttcagacatgtattggcatttttattgaaatagattttcatgctgatggtagctacaaaaccagcagatctttttcattgagaaaatgagacacaactggcatgtggaaaacaaaccaaaaaaatgtgtagtcatgaaccagaaagttgacagcttgttctcattttattttggttttaaaaacttggttttacacaattatacaaatcagagaggaaatgtctagacatgtccaagctctcatttctgttgctacagtcactaatctcatttctttgacgtaatttttctctataacctttactttttagcagtctgtaccatttagtctaactttattagcattgatcatgagaatatcttattttaacagggctgtaagtgatatttgttagatggttatatcatttaaatattcccttctcagtgagggagaatttttttacttatattttaagattaatatgagtatggcatgttgaaaaaccagcctaatcatttattatcatggcgatttactatatatgtttataaatagtcctacataccaattaggtgataaaactttaatttgaagtctataaaacagtaatttaatttttaaaactaatattggtatttttgagttttctaaaagcttttactgattaagttattatttgtaatttcggcatggtttttcatgggctaagttcaactcttttcttgcttactggaacaataagtagattatcaatatgaatgtgcaacttatctatttaatgaattaggttttgttattggggatttgtgcataccatttgttaaaggttagtgcttacatgtctttttaacctttacctgtaaaaactgacaaatacttcactcttgcgaattaaatgtaaacatttgtcattttcaatgtttctttatcctttgaattattttattaagacaatattttaatttcctgttttaaggttttttatttgaaaagactacaaatttgataggcaaaaatcacagtatatttaatagggagaagagtgggacttgtcaactcccataaatctataaagcaactcatatatcagcagaaaattcaaataacattgttttagcctcccctaacatactgcatggtagtccaattccttccctaagatttctgcaaatttacaaaggaacatggtgagtggggaaaggttatatgctcaagttcattctatcaaagcatttctgcttattctggagaggtttctgttatggatcacttcaactcagagaggaaatcatgtctcttcatcaatgctcacaaatcgaccatttacaccagttattctcaagagcagtaaactttcctgatgatggtaggagagacaagagaggagggttatatcacatcaattcaaatgactgaaattggaagtcagtcaatcctgctattaaaatatctgtcaggatttcagttggcctaaacttcatagcattccattggcttctctccctttttcctctcttagcatcctatctttctcttttgtcaggattaaaaaaaaaatctcatttttctactacaaaggaaattttgtttttctacttcctacaaagcctcactgttgctttgttgctttggctttcacctctgccaaaatattgctttctataggttggtaaggcaatctcccagacaaagaaaatttcctccctaatggaaatccttgtgccagctgttaagtattaagatagaacttttattttagtgtgttaccaagatttttctttgtagattgccaactcaagattgtactagatgctaaaaaaagaaaaaaaactgggataaatgcaaagtgccttattcagtggctttgcctcttcttcagtcttctttttgttggtcctggaaatattaacccattaaaaaaggcagatctgttttataatgacaaatattggtaaagaaacatgggatcaattgttgagaaattgaaagcagtaaaaaaacctgatcatagagtaaccatgtaagtaagcaaaatggggagtcatgaatagagtgttgacaaatgagagtgatattggcaaacatgaaattaaaatgtactttggacaagcctatcgctaaacctgaggatacttttgatgtaaaaacaactgtggtcctgactgattttactctaaagttcatgtaaaaaaacatccttggtgacacactgacattgatttcctttagtgtaactgaggccatatactgttctgatatttttcagaaactctttttagttgggattagaagctaatagtattatttttgaaacctgtttttttgttttaaatggaatatataggctgtttttggtatatgaaattaatgcagaaggctattctacttcagccagtgcactctaagcaaatccaaaaggagccctcatattttgctataattagagtgaccattatcaattaataattaaatagttcccactctacatgtggaagtgtggagtgtatccatggaaatatagaagtaatgctctagctattgataataccatatttagaagacattacttctaagacagcattaacaaaactatgctttactatgatttattttttaaaatttcctgttcagttaaagtttgtatttatttttaccaactgaaatggtaatttcagattattttgagtattaatttcagattattttgggtattaaatacttaatactttctgataaatacaatttaattttttgaactacagtaaccaagattaacctaagaagtattttaaatatattttgccatgtagaagtgcttggtgttttatctaatcagtgagtgatatggtttggctgtgtcctcacctgaaatctcttctccaattgcaatccccgtaatccccacgtgtcaaggggaggccaggtggaggtcattgaatcatagaggcagtttcccccatgctattctgatgatagtgagtgagttctcacgagatctgatgattttctacgtgtttgatagttccttctgcgttcattctccttcctgctgccctgtgaggaagattccttgttttcccttcaccttgcaccatgaatgtaagtttcctgaggtgtccccagctatgtagaactgtgagtcaattaaacctctttcctttttaaattagccggtttctttatagcggtgtgaaaatggactaatacagtgaatgacagcagaaatacgtcattggttattatacacactagtgaagtcaaagtctaataattgtattcctctcagttaagtaactttctcacttagattcattccggcaacaaatatttatggagcacctactattgtcaggtttatgcttagcactggaaacgtaaaatgagtcatgttccctcttcttaattgatttacctgctttatcgacaggcaaaacagggattatcagtgatacatctttgatagtagtatgctgccttgagtgaaatgggttgcaaaagatggggatccacactgggcagtttggctttcccagagaaggttataccagctcggtgttaaataatacgttcttgtgggtgagacaaaaagcgacaagcatttttatgcagcgaaaacactgtgagcagaggattggagataggatgcagccctgtgttatcagagcaaatctagtgggaaaattactctggaagttatggaaatgtaaaatgtgtgtgtagagtaggaaagtttaagtagatttgaggcacagagaaaaaaagacagacatgttaagagactattagactaatatagataagaaataggaggcctgaattgaggtagtggaagtaggaaggaggaagaagtaacgaatgagatcattgactcagtatgacttaggatgtagtggaagcaacaccctcccacgcacattgaaaaacagctggtataaccttctctgggaaagccaaactgcccagtgtggatccccatcttttgcaacccatttcacagtgttaaagttcttattttaacaaattgtacaatgtgaaactaaattttattttttatttggtagtattaataaacaattatttacatccaacgtgtaattatttgtattcaatgtgtacttttatatattagctgtgcaatttaaagatgttgaaaaactttacaaatacatagcaacaactttacaaatgcattgtggcagtcttacttttttttaaatcagatatctttctaaagcagtggtcgcaatttctaaattttattttgtttcttcatagatttgaaccaatacagagcttatagtggggtattcaataacttatggaattctactctctgaaacctatcttcagaattttcactgtgacagaggaagtgcaaggcaagggacaatgccatctctcatagtgatttttactagcaaagaacattgattaaataagcaataagtttggattatttgtagtatgattagtagtgggttcaaatatgccacttctgaagctcttgagttgccaccctagatgttttctgaaccatattcttgcttatttatgtcttttaaacagaatgtgtattgttaattataatccccgttaaaacttatctaactgaaaaatttttttaactgtttcttctatttccttttgttagtttttatttcattttatttatttatgtatttatttgggatagagtcttgctctgttgcctaggctggagtgcagtggcacgatctgggctcactgcaacctctgcctccccagttcaagcaattctccctgcctcagcctcctgagtagctgggattacaggtgcccaccaccatgctcagctaattttttgtatttttagtagagatgggtttcgccatgttggccaggctggtctcctgacctcctgacctcagtccgcctcagcctcccaaagtgctgggattatgggcgtgagccaccatgcccggaccctgtgttagtttttattgattcactttccctttctcctcaacagaagagttatataaagtagggcattaatatgaatattttgccaacataagattatattgaaagatattgggcagccagttagagtgttgtatagacttttctaagcatatggaaatatgtcagcattggtttataacctgaatcttttttctctttataactttgtagtcaaccttgtcttcatttacaacagatagttttatgagtctactgattgcaaaagacaacaaagaataaaatgagaattttagtagagtagataatagtcccagttgcttggctcttttgatagcacatatgaataattcaccatccatatttaatagcatatgttatgctccttaatacatttataaccatctccttccaaagggaaaactatcctgctatttgtggtttgtttagtttttcaatgaaagctgaagagaatgttgaatatttgccccaagacctactacagcctgaatattactactttagcatattatcctccattgtattttctgaaaagatttccttggggatgctatcagagtttgtaaaaatgatttttaaaacattttaaatattgctaattgattcttacactgtatttttataacatttaaaatgtatatatgtaactacacacacacacacacacacacacacacacatatatatgggatatgctaagttggtatttatgtctgatatgaggaaatgtctaggtaggtaatgttaagataatattgaagcaaccatctcaaaggcagtgaaagcttcatgatttatcattattgtgagttattgggattttcttcaggtgtcagagaaatttgaggtaaagtacattttttaacatagaaagcctactagatttttttcaatgattcctgttttatttcaatgcttaggtagattatatattttagacaagtatgaaattataggtacagaatttataagttcaaaatgcttctattattgacaaataacttaatcactggaaacatttatcacttttattggcgtacctgacagacagcagactgctccggtcttgaaggaataaggctgcagaggcatatcataattcaattgaaacacatttctcctatcaggaaaactaaatagcatcaaatacctttgactttacaaagtacaatgacaacaaccttgactaaacacagatcatttgcttcagcaaacggaataggtctaagtattagtatactaaatcctatatcttactccaaatgatgtaaactagttatatatttagaataatatattgtgcagggaattcagcaaagaggtaactcagtttcttcactttatagatgagaatatttaagtatcatagaggttaaattattttcctcacatgaagcagctggctagtggctaagtggggctatatcacaagactgtgattccagtccagtccagcatttcttttgcattgcattataattatttttaggcataataaattaactttaatactttttctttaaccttccaagcataaatatttttctttataggaactttgtttcacttttaagaactactaaatcactaagtacaaaacatatttgtgacaattttggggaactttgtgatatttatataaaatatgttgataagcttgtatgttagtcatttgtttaagtcattaattctgaaaagtaactcttacagaatttagaaaaggatttgcaccataaatattagtagagttgattacaacggtccgggaagttttatagggataagagcaattatattgaaatatacttggatgataaaagatgaatataaaatgaaagtctttaatatgaatatttcttttacaaaaatacaattatagcaacatttctgcataataggcaaagaaaagtgatagttcttctgaactatgatacatgatccaaaggagctttatattttcaatttatgctgcagtttttctggttggtataaaacgtaattagcaggcacagttgcaccattgcgcttttttttttttttagtaaaacagctttacttttttaagggacagctggtggtatgtctataaagcattatattaaacctatgggtttctagttatgctgttttataattacatgaaattcaatcaatcaaccttttagtgatggaattggtgagtattggtgagccttagtctcatgtcaagattttcgctgggagaagaattgactgaggaataccatgccttggtgtgttcagtctcctctccctagaatatttaacaagaacaacttaagtaaaataaaagccttcaagtggtgggagaagtgatatctccaagggaaataggcagtttgagaggatttgaagggaagaagtctgtgaatcagtagtaaccgagcatttgtgaggccagctttccatgggattattgtcagatcagcatgtctgtagccgaacttgaaaagcagcaggtaaggttgcatgagggggtggggcgggggggggaagctaagtagattatagaaagtctgccaaattaaggggttttccttctgagctctttatgagaagaagccactaagacatttgagcaaggaactattgtaatgtagagcacctagaagatatatttgtgtttactttaagcattaggaccaccttaaccaattctttggtggatgaagggagaccaaattggagggggagagcccttaatgatcttttgtttattgaaactaaaagtggcttcaaaaatcaattttatcaaatctgtttccacttttcaacatcaataaatcagtggagctctctgttagatatataataatcaagaatagtttaggcttaggtaatcaacttgtaatacttgcacgtgtaagattctctgcagcaactgtgaggtattttgatttacaagtgtctctctcagtaacgaagtatatgaaatagcaccaagtcctgacaagaatgtagttatgtggaacaagattaagtctctaaataccctgtacaaatatttggttatagcatactaggctttgaaatcgggaactatggacagcactattatcaggcaatatttgtctttaactcatgcctttaccccttttcaggcagtttcatacattggggagaatttaagggaaataaaggctggtactttccctcaattcataccacacagatgactacttactgtgcctttgagtagagtcagtcttatattctgacggggtgatattttgtcccaaatgtttagtaataagtaatgctttagtatattaatcataatcatgtaacatttattgtttaataatgtttttgctagtatgagattacaatatcccaggctatttttcttatgaaccatgagttttatttccatgaaacactggtctaaaagttcaaagacactgaccattctaggacggctgcttctcaccagccttacaaatgtgtgcaaatttcttcacctcctgagcctcagtactacattttaaaactggaggtaatattagtcccatctccaccacagtgttattgtaaagataaaatgagatcatatgcatgaatggaagtcattatttttcacttttatgaggatacttgttttctattcttttgacaaagaaccttcagggccatcttttaagatatgaaaatcaccaatatgtataaaacaaactactggaaaaacacagtgcgacttgcatatacagtagtacacaaaatataatatgacttacacatagtaacacacataatgtgacttacacatggtagcccctcttgtttttatatcaattttttcactcaacaaatatttatcaatactatgtagtaattatagcttttttgttctagtgttatggatacagcattaaatttaaaaagatcaaactattggtcttcatggagcttgtctttttgtaggggaaaagcagacttagaatatatatttttaagaatcacatagaaaatcacacattaaccctgagtaaatgttattttattttattagcagaaaaaatactatccactacgggaaaaaaaatctgtatttttaccttcttttgatttttggctaaaaattatgttcagatggatgtcaactataaagttacaagtcttcatctttttacttctatttagattgtatttgaaaattgaatataaaaaagctctaagtagacatgatcaagtcttaaaatattttaggcatcattagtgcttctaataataattttatagtaacttctagtctccttataatcatcctgcctttatttaaccaaattattctgtcttgtttaactgttattaaagaatataaagaatgcttaagaaaagctttaaaagtcctctctagtagtagaagtataacttccatagtttatgactcccaaagtcaatgcaatgtcttcataggttacataggcagagaatgtgaaagaggtcatgagttgtggttttttaaaacctcttttgtttcattgtgtaggaaaatatctttatcagaagaagaaaacagtgtttataattataatgtaaacttgttaaagattttcatgtaaaaggtgaagacgaattttgtgtgaggtttatcagagagatcatcaagagaattattttcacttttgggaattgttccagttaatatattgatcgatagatggatgtcttcattggttttgcaggaacctgatttccaattttgcttttgccataaatgacttaggccacttttcctctctgggcttgtgtttcctcatctacaacaaattgctcagcccaaattgtatctaaattattttatttaggttctcatattcacaaataaacactttttttaatgcttctatttaattttcaaagttttttttgttattgcatttctgatatggatgactttgtaaaaacatagtaggtgaggttgaaaaaagaccacaggggatgaatgtacaaaaaacatgtaaataaaactattggagttttctttataattctgagggtctaaggatctcacaagttatatgcaagagaagcggcatagtgttttcagagatgattaatatttagaaaaattcaattctggttaaaatagatttagctaaagtaatgatagttgactatattttaatgggaaattttaaaatgttactcttttgaataaatgaccaccagatttaattttttaatataaacctacttctagaataccccccattctgctgtttttcaaatgtcaagtgccaaaatgtcataaatatttagggaagagggtttactctttgaacaaggagatgatacacagctttattctgtgagtaaaaattgtgatgacaatcatcccagacagatactattttccaagtgaccatggctagagaaacttgaaaagtggaaacagggcacttgatattccatgggaactctctaataagatttgaagaagtgtctgtagatcagttaattattctattgtggaaatccattcatttaaaacacagagagcacccatataggcacttttatcctccccccgcccgcccacactgattcattcatttttattcttgagaatatgctagtattttgaaacacttccatagaagctggatccatgaaagtatcattttgccaactatgataacatagtgttagaattttcttggtgaacttactgatttactgtgttttgtaatctagttgttgaagagtcaaagaaatttttttaggggctgttgaaatgactatccaggtttatccaggcaagtagtgttcctctgtaaaactctcattttctaagtatgtggtatgattttaaggactccagataagctgaaatatccagcaatacttctctgacaagcattgtggattatgaaatcccagcattagacaacatattttctaaggttaggcaaatattttcttagcagcctgaaataaaataaaggtactatatagatgtatattttatcaagtttgaaaatatgacattccttgcttctgaaagagaagcatccaggtccaacattttagtataattatcagagaaagaaaaaatgttaaagtgctagtgatatttttaaatgactatagctgttatctgaatattaataagaattaatctaattaagagtatgttcagcaatatgatagtctcataaaaagacacagaggatacagcatggtctttatttacaacaattttttactctttacagaagaatgaaacatagacatacagagatatgtaataaaaataagcactaaataattaagtatttagaacttactacatattatgcaacatactgtgctatgctaaacagctttcttgggccatctcatttagttatcaacagggtcctataagtgggaatactaatacctccagtttgcatataagaaaacaaagatatagaaaatttaagaaacttctccaaagatatggagcctacatatattagtgaaagagtcaaaccctaggcagtttgcctaccctgtgctcttaacctctttatgagtctgaacccatgaaggggtatagtgcaggcatgaattgccacaggtgttcaaaggaggcagaggtggttaagaaaggcagagtagaaggaaagggactttagcttcactcagaaatgtgtgtacaatagataagtgaagaagtacgttgggggtgttaataggaaagtattgtcttgaagagaggcattaacgtaagataaatgttgataaaaggtatcgttgtcttgttgattttaatagtttttaaattaggttactagaagtacttctccctattgatatttggcctgccctgggtttaactcttgtaacaaagaaaccaatagcacaactccagcacagtagccttaggaaagtgatgacaatgacaacaacaaaacaaaatcctcagattaatataggtattgtactaagtccttcacatgaaattctttttgaatctttattttcatttctggtaataaggcaaactggatgatggagggaataacagacatgcatgcgtgcacatacacacacaccttttccaaaacataactgatcttgtgagaaagtaagaaaagtcttcagggattagaaacggtgagaaagttggcattcagacaggtgtctaccactccttgatgacctgtagacatccatgagtcatacatgtgaaagtcaggaacagatcttgggccttagcaaggcaaaagttgaatggaatgcatcatccataaagctgtaacctcaagtggctaatatgaatgaatgaggaaaagaagaagtaaaacgcctgtctgtacaaacaagaaatcagtttgtttgtcattctagaccttgtttctggattaggagaaaaaaagaaaaaaaaaaaaaacccaaccaaacaaacaaaagaaacctcacattcatttgggattgaaatttataccgtcaatgtggatggcctgaaaaacctcaagtcagaaatatagttaggtcctcttggattgagccctagaaatttggccgaagcaaacacaaaccttcactggaaaaatgccctttaactttttcaatgtttctaatatgttttaattatcaaaaactcacacatataaatataaaaagaatattataatgaatgcctgcatacttaccacttaaattcaatgaattgtcagcactttgccaaatttgctttatatttgtctcccgtctctgtctctattttctatctcattattgaagcatttgaatgtaagttgttgacatcatgatggtttacccaaaaatatttcagcattcatctccaaaaagtactttcttacatactatactattatctttatcacaactaccataattaataataatcctttaatattatctcatgctaatctacattcagatttccctgggtgatgctaaatcatatagtcattgttttcactagctggggttctatcatagtttgcatatatatatatgtgtgtttgaatgtatatatgtgtgtatacatatatatatattacatgtatgtatgtattaggtatagcttaaactttttgtgcaaaaattgtttctgttatatacttcatattgcatctcatcgagaggtacaagaagttaggatgtagcagtattagtaaggctaaggttaatcacttagttaaggtggtaattactagatttccttgtaaataaatgtacttattattgcttttggcattatcaagtttctattagggtgatactttgtctccagttgaaagtcttatatctagattaccttttacttattagtttaaacatcctataatgatactaactgaatcaattattttattgagacttcatattcattagctgatagttaacatttattagctgatattaatctgtaatcatcaattgggaataaaccacagttcctcctaaaatgtaaatgcttattgttttccctctaattaccaacttcagagaaagttattggcataccagtcatctctagtaaggacaaatgaatgaacctctttcctcaaacccatttctctctctcaaaaatgactatggactcatttttttaaaaaaaaattctatgagttataataaattaatgttattattcttttgaaggccacattgtcctaagttgtctcctgtatctttttgatatggcttcttttgatctggaggattttctttctatatagcacaagatgttctgggataaacttgtacttttccttccccagacctggaattagacatttctccaggaagccattgagtactatactttaaagacaaataaattttatataactttactggtgacatgagttcacaataaaaacaaacaaaatcacaaaatatgtgatgtaataagtatcaccagagacagcacagaaaacaaattctggaatcagaccttcgcagactgtgactattacaattatatttagaaaaacaaatatgtttatcatattcctgagaataaaagaggatattggtggtttagcaaaggaacaagaaaaaaagactatcagaaataaaccggcaggtttgaaaaagaattaagtagaatttttgaaataaaaatatatataattttgaggttaagagcacaatagatgacttcaaaagtagatttgacacagctaacagaattagtgaacttaaagatctaaggaattatccagaatataatacagacaagaaagagaagagtttagatatacaaatagaataagaagacataatatacaattaatcaagttgtccagtgagaataaagagaagagaagagaagcaataggcaaaggagtaacagggaagatgtttctggaaatatcaaaaggcgcaaattctcaaattcagtaaatctaacaaaaaagaaattccctaaacacattacaatgaaactgcacggtatcaagaagtgacaaaaaaattttaggagcaaccagatagaaaatacagaatgcctacaaagaagcaaaatctgactgacagctaacttctggatagaaacaatggaagccagaagttagtaaaatgatatcttcagatttcttagagacaatgactgttaacatagaatcaaataataatcaaaattatttttcaaaaacttggaaaatagaaacattctcagaccacaaattttgggaaatatttactaatcaataaatcatcactaaataagcttttaataaatgtaatttaggaggaaaaaagagccttcaaacaaggtcaggaatagaggagaaagtagagtgagtctgcagggaaaagcagaagtccaatcaggtagcttcagcagtttgcagtctttgcctctataaaaacattatatattattggaatttgtgtatattttactttaattatttttcagcctacttagccccttttaccaaatataaaatgggtggtcatcaagcaacaacattatttctcaaaccatgataaaaactatttcaaagttttatttgatcagtctctaaatccttaggttattatatatattttatatataatatgtatttatatataatatatatattttatatataatttatatattatataaaaattataaaaatgtatatattatatataaaaattatatatataatttattatataaaatatatatgatatttttatacaagcaatttataaatgttatttatatacacagcagaaacagttttattagtatattacatcctaaggcaacaattttaaagggagtaacactcatttatatatgaatcttgaatttataaaaattcagttcatttcagtcacagtacataaatttacctgtcactgtcaccttaagtcttcaataaacgtgaactttgaggtctactactgctcgaactgttaaatgcccattttgaaaaattctactcaaagacccattctgaatcagtccagagtgattgtaggttacagtttcaaataaattaaatttaaaagagttataattttggctaaactactcagttatttctttactgtattacattacattattttaaaaaacatacttttaaaaagtatattagaacacttgaagtttaaaaactttaacaattattacttttactgattatattatttataaaattaataagaattagtattcattgtagacgacttggaatatattatttagctcaggataaatattatacatcttaatacatttaaaaacacaatacttcatattatgtaataccagggccaggcatggtggctcatgcctgtaatcccagcactttgggaggccaaggtgagcagatcgcctgagctcgggagttcgagaccagcctgggcaacatggtgaaaccctgtcgctactaaaaatacaaaaaaattagctaggtatggtgacatgcatctgtggttccagatactcaggagactgaggtggtaggatcctcttgagactgggaggtggaggttgtagtgagctgagattgagccaatgtctgggagacagagtgagactctatcacaaataaataaataaatgaaataaaaagtaatacctatatatgcatttatatatatatatatatatatatatatatgaaggaaaattataatctcttgattagagattgtcaatattttggtatatgctgttcagactttttccattatatcaattatgttctctatagtatataaactatttgcatatattctatattgtgtatgtatctatcatctacccacttacctatctacaaatctatttatctaaattcctaggtattaattctctcatttagcctttaagttgcagataaaggccaggcacagtggctcatgcctgtaatcccagcactttgggaggccgaggcgggtggatcacgaggttaggagatcgagaccatcctggctaacatggtgaaatcccgtctctactaaaaatacaaaacaattagccaggcgtggtggcgggcacctgtagtcccagctactcgggaggctgaggcaggagaatggcgtgaaccagggaggcagagctggcagtgagccaagatcttgccactgcactctagcctgggagatagagcaagactccgtctcaaaataagtaaataaataaataaataaataagatgcagataaaattggattggtttccatacattatgcaaagtttgttgacttccccaagatggttcttaattcttggtcacatgaatttctgattatcttcttatgacaaatatcttaatgtggaattactgaataaatgttataaatgtttttaaggcttctgattcatgtcaagttataaagtttgttatcagttcagacctcaaacagggtatattggagatgtgcattttacttaccaatgttgggttccattatacaaacacacctttttttttttaacataagatttttctaactaaatattaaactgattttattttctttcctaaatcatatactgactacaaaagcacataagaggagaaaggaaggatgtgtgctggtattttacatatctgaatttttcttttcttttttatttttagatggagtctcactctgtcgcccagtctggagtgcagtggcgctatgttggctcactacaacctctgcctcctgggttcaaacgattctcatgcctcagcttcccaagtagctgggattacaggcgcacatcaccacacctggctaattttttatatttttagtagagatggggtttcaccatgttggccaggctgatctcgaactcccgacctcaggtaatccgcttgtctcagcctcccaaagtgctggggttacaggcgtgagccaccatgcctggccctggacttttcctaaagaaaaaaaataaaataacactatgcctacatgaccaaaaattttcaacctgataataaaacattgttaggagcagtgatgtgacataatggctgtgatttactttggaagtatgcctgtaactgccattagtaataatgaaagttaatgacatgccttatgggatcagacaatggtcttcaatatttgtaactacttgctgggatagaaactattctgaactgtcagtgggtgtcagtttgtaattatagattgcacaaacactatgcatgatatatattttgtcaacaatgattaaattggcatttagaaaaatgcttcattttcagtgaccaagataaacacaatctgtacctttttaaagtaataaggttggagagtaagcacccatgaaatataacttataactttcaaacaaatcatggacaaacatgtatttttgggttttgtaatgtttaagtgattatttactaactagagttcgctttcaaattttaaaaagatctgtagttatcctgagcttgaaagtcacttatgtttcagacccaaatataactcactcaattttgctgaaaacctaaggatttaaaggctgatcaaataaacctttggaatagtttttatcatggtttgagaaataacgttgttgcttgatgacccatggttttatatttggtaaaaggggctaagtaggctgaaaaataattaaagtaaaagatatacaactttcaagagctaaatagatctaattcaccctgtctcctctaatgttctgctcactcactctgctccagtcactctggtctttccaagcatgctaaattcctttccacaccccaaggtactgtctttttcattttccaataatctgcttcattaagcaagccaatttaaggacactaccccatctagtttttttttctcctcccacctttcattttgcttccttcatagattttaccacagcattggaattctgtactcacccttccatttgcttcttcaatttgaacctcctgcattggatgatgaactccataatgtcagggataatgtctaactttccaactttctgtgtttaatacgtgccatagtactgggcacatagcatgtgctcaataaatattttgttgatttaatgcaataatgaatgaccaaatgaatgagtcagaaatatatacaagtgtagatctttagtttgatctattcactcttattgagttttgtggaaatatgacattttgcagttttgattgtcacattttaaataaggtgataacatttttgttccaccagatgggaggataaagctgaaaaaaaatgctgaacctactatacatcttgttattgcttattgtttttgtttatatacctaacatattaaagtttcatacttagtactagagagatatttcttattttaaaagcatcatatgcttaccttcataggtaatttaaagttaacttttaagttctgaattttaaagtgttatgaaatttcactttaaaataagaaatataaatttatggctaaaatgttttaaataggcttattgaatattccaaattaatgttaagcattcactgttttacaaccttatttattattattattattattatactttaagttttagggaacatatgcacaatgtgcaggttagttacatatgtacacatgtgccatgctggtgtgctgcacccattaactcatcatttagcattaggtatatctcctaatactatccctcccccctccccccaccccacaacagtccccagagtgtgatgttccccttcctgtgcccatgtgttctcattgttcaatttccacctatgagtgagaacatgtggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctcttgtgaatagtgacgcaataaacatacgtgtgcatgtgtctttatagcagcatgatttatagtcctttgggtatattcccagtaatgagatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgacttttgaatgcttgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttatcagatgagtagattgcaaaaattgtctcccattttgtaggttgcctgttcactctgatggtagtttcttttgctgtgcagaagctctttagtttaattagatctcatttgtcaattttggcttttgttgccattgcttttggtgttttagacctgaagtccttgcccatgcctatgtcctgaatggtaatgcctaggttttcttctagggtttttatggttttaggtctaatgtttcaagcaatggggaaaggattccctatttaataaatggtgctgggaaaactggctagccatatgtagaaagctgaaactggatcccttccttacaccttatacaaaaattaattcaagatggattaaagacttaaacgttagacaaccttattttttattaatactgttataaatactgtaagataggtgtgttcacaaaagactttgatatgtgatgatgaagtctgatttaggaaaagttgataatatttaaaatagcattgctattttcttacgcttaccgaataaaaatgctttggtgaatctaaaatatgctattgaaagaaaaagtactcttttctccagggaactttatatttttttattgatatgttagtacattttatagctgtcataacataaggctttatttgttttagaacattgaattacttctgcagcaaataaagcttaggactatattggtttataaaagtggcaatgatatttaagtactttttaatgtgctttgattttatgattcttaaatttcctaccttatctttttattttatcctattttgtttccttttggagaaagttaagtttccagaaatcattgctaatttgtaatagttaacatttaactttttttctgatttctgccattaaatttgttgttttcaaattggagtatattatttgtgttagatttaagtcatagtatatactatgcctaatatagtataacttatatactatgttaggtttattagcttagtgtaagcatatacgcgttgtaagatccattagggtggggaccatgctggaaagcttacaacagtgcttggcaatcagttggtttccagtgaatatttgtttactttcttaatcagttaatgggtgatagggcaaaagtgaactgatattttaagcagcagaaagggccagattggctatccttgtttttttatgatattataggtgtcatttatgttataggtagtataacatttatataatgtgtactttctggctcttggatttgctgtaattttaacatcacatatggatataagaacttgaaacactgtaaagtgaaatgctttgacacaggagttaatttacataatggtaaattctggattaaaggccttaaagtaagttctatcttatatcaaaatgtcagtattgattatgtatacatagaaaggttgtgtttttttcccaaagaaaaccaattgttgtggttaaatttttaaaaaccaaatgagtttagggattcaagattctcagctaagtataggtctataatcataatgataagttagaatttatgattcacagatatgtgggatttatgtgaataagatatttttttaaatattgctgagacttagagtaatctataggttttctagataactatgctgttcttttatagaactaaatttaatggagcagagagttaactaacttttaagttaacgtgactttgcagataactacttttggtgaatgattttcaacatgatcatgatgaattttaatatactcaaagttttcggtctctaattattaataaacttaaaataggtcaactagagcttagaagaaaaagcgtgaacttgttttttcttggtagtacccttgtcttctataattgacggaaggaaagtacatactataaaagcaactatataagactaaaattattgtttggaaattattatccttcaaagacttgtatttatgtttattgacttcatgttattaatatttcacaaccagggtttagattccaactcagctctatgacctgatcagattgaatatatttgtaaattcagtttaccaatatttaccttgcaaggttttagtataaatgaatataagttattccaaatgtttagttcactgactgtgcttgatgctatttattattataattagtcttattaatattaacagtacttcaaaaattctgataactttcttcaaattgttcttttctcaaaaatggggattaccacatatcttgagataattataatgctgaattacttttgaatattaatgacagtgatttttttctcagcttgagaaccaaatcccttgacaagcatataagaaccatctacaacaaaataagtatctgaggaaacctgtcagctacttcaatctgtatttcagcattaatgtgtgattctatgcaaacaaatttgggagaggattttaaaaattccactaaatagggagaacttttctaaacatctcattttagacaattttcaaaactaccaagggatcttgaggactgaaaccagtttcatttttctatactatgttattaataaaaattcaaagatcagttaatataatgcatattgtatgaactttgaaatcattatagtaaacatttttttgtcaaattacttataccagttatcttgcttgtgactgcagattgcataattgctgcacagatacttaaatggcaacatatgtcacatttatccactcaatggccacacttcattgtgtatagatgtattctgatgggctttacattcaaattgacaagtgaggcaattaccagtcaacatgtcctacaggttctgcatctggcttatccatttgtacttttttgttttgttttaaagtaacaggatctgtagaaagaactatagtaacctgatttgaaacctggctctaatgctgattagctatgtgaccatgggaaagttccttagcatgtttttgttttgttttgttttgttttccaagacagggtctcactttatcacttaggctggagtgccctggcttgatctctgctcactgcaacctccgtctcctgggttcaagcgatcctcccacctcagcctcctgagtagctgggactacagatgtgtgccaccatgccctgctaattttgtgtttttagtagagatgaggtttcagaatattggtttcacctcaagtgatctgctcaccttggcctcccaaagtgctgggattacaggcaagagccactgtgctggccagttccttagcatctttgaattttagttttctcatctgtaatattgtgataataactgatacaataaggaaatattacacgcttgtaattttgcaaaattaatgaaattgatatagggaagcaggtactctcctacactgttggtaaaaatattcattattaaaacatatctatgaagcaatttggtaccacctaatacatattgaaaggtacattcccattgagtcagcaatatcatttctgggaacatatgctacagaaatgcattggtacaaaaagatatatatatacacacatacacaaagatgttcatttgagcattatttataatagttaactttagacacatttaaatatccatcattagcgagaagttaaatgaatcttggtgtatgtagtcatgcaatgtgaatgtgaatgcactgaaataaaaagatttccgagacatagaaaataaaaaatgaaaataaatgatttagacaagatattgaaagtattacattatgtaaaagtataagaatatatatgtaattgcattatatattcattaatgcattttataattcctgtgtgttatcataattactttgaagaacagtaaagtgatactcaattattaaaagtgattccttttgggaagagattgataggatatctagctgtcaggtattggtgaatgggttccaattcagtgtgcgaattgaaacactaaagaccaaataaacaattacagtttttcaatggcaaaaaacttactttctactattattaatccccttgccatcattctagttcagggttttcattatctcactcaaagtggaagattgcaggatactctagagtataaataaattctatggaggacttcaggactttttcaagctgcatttgccatctccctccccagctcctattctcattctcttccccgacacaggatggctgctctattgaggaataacagatggaggtgggggttatgtgctgtaggtgatgagaagcaaggagttaaccaaataggggaaaaccaggagactactgtggcattattggtgcctgggaaagacaaagtttaagaagaaagggagtggtcagtcatgtcaaactctgcagagaagtcaaataccttaagtgttttttttgttttgtttttaatgagcatttgttttgtttagcatagagataaatacttactgatcttgctgataacagttacaatggagttgtgaggaaaaggtataaataaattgatgagcaggaggtgagagcacagatagtgtagactactccttttcaagacatttggctatgaatagaaaggaggaagaaggggggaaagaggcactgtcctacaatttgttgcatcttattgatttttaaagacaattttaaataatatgtcatcctatccaaagtcatcatttttggtagacatcccagcttcaagtgattaaccgaaaaaagcaaatcaattccattccttaggcatacattttatatttagtttttcctgacaggcttccaaaaaagctatgttgctctagttttgacattcttctggatgttttgctgagatttatgatggtcaaaaggggtaactttgtaaattttgcagtttacatttattacattcatgatttatgtaaattttagagtgtttctgtcttctctttctatggcttgaacaaaattcctcatgttcttttaacacttttccctgtttcttaattagtaataagtttgaccttgcttaggacctttttgccaaccaaactctatgccttcttccatgctagaacactaggatagattgtagaagcaaacaagatggtgcagcaggaggttgtgggaagacaaggtaggcttatctagaaatactatgtagagactatctggaaggttcaaactatggagaaagtgacttgtagcatcattgtttaattcagagacttatcctataatttatacaaaatcgacaaccagatatttctaaatactacatttattttatagatgagtaaactaacactacatatcaatataatatgtataaagtggaaaatgggtcatattctaaattgcatatttatctttggtcctacttaagttattgcactgatccatgaaacaactgaaatattgcactgtgtttagcatactttcctgagacatacacaacacatatttaaaatcgtatgtttaaacagggatactaagtctggcataaattattacactcaagtatcaggatatgaatcatgttgccaggttggtgaactacatttctatatttttttctgatttattatatgactatagcaaaatttgccacaataggaaagtcagaaaaatgcattatatcataatttagattttaacaccataggattttttggtaatttttttcagattgtattttttaatctgaaataccttttaaactgaaaagaaaatttcctattcaatgtttgtcatgtatttaagaaaaagaacaacaatataaattatactagggtggctactatatataaaatatgtaatacattatatatattacatatatagagagatataaactgaatcagtagttgacacactggatttagtaatggaacctttagttaaacatattacataaaatactctgtttattatatgttgccttcattaacaaagcctttgtggaggttatgagataacatataaaaaaataaggtaactttttttctctagcaagaagttgcccagaatttatgtagcctaggatcctcctggtgtaaactgtgcatttcatacataccatcagaaatatgtatgaaaatgatgtgtccctagacacaatcctggtgagttgcagagaggaataagaagtgattattttttgtaagtcagatataaaacttgttgttaagtcagtactttttgaaataggtagactaagcatcattttatatttgttttcagggaacaagttcatttgataaagtgcatttgagctacttgtcattaagttttttttgtttttttttttgtcgtttttttacttgtcattaagtttaaaaattactatgtttagtatttggtcaatttgatatcttaaattgttgaggattgcattttttaaatcactcacattgttcaattatcatacatttctgtttcattttctttaccagttttcagttattctgctttcatgtcttctagtacctggcacgttttgtgccaagagaaattcgtttgttgctgcctttgaaaatgttgctcaaacttatgtcagttgcaaatgacttgccgaagctttcctcagttaagcagctggcagtctaatattttcttagggaagcctgaagagtgttttcacatattgactcagcttgccaactctttctccttcaatgtttcaggtgtcagtggctcctgtagttattagcaatggcactaaactaaaaatatgattggtcctattataccagacatggaaaactgaaataacgagccagagcaatactatccataattgcatagacatttccttactgaatacacactagttctctcaaattattggtctagtttgacaaagtcccaaaggtgtaagtagctaatgtacccagttaaagtgaagagaaattggggacgagagaatgattgtcaaaacacttctctgatagaaccttgaagaatataagacttagagtcacttgtatagacagaaactgcttgaagaaattagaaaaaaaaaaaaaaaactagaaatcagaagacattttgtttttcatctgaaaaatggagcaaaagtagtggcgatctctaatcattcccataagaaacgtttttttaaaaagctaaatacattaaaagtcaatcttaaaacatgcaaaaaggctttaaatttggatcgaatatattgttaataggcatagattaacaaattgcaagtaagtaatcaaaatataaatctttttgagtactcattatgagctgacattgttatacgtactttgaaataaattaaccaatttaatccttgctttcattcaatgaaatatgtagaataattattctcattttacagatgaggtctaagctcatttgcaaagctggggtctaagcccagggagtctggctttaacatccactagctgaactccttcactggctgctcttaagttaaaaacactgttcatgtgttttaggactaggttcaactagtgggactttttttcttccaagtaaaagaagttggactaaatattttctttttgaaaaatcttaatctcatattaaaattcaaaaatccatatcctcctcattgccttaatcctttaatataatattgaaccctatagaatatttgttcttgcctaaatggtgccaaacatatttaatttaaatggtttttaaaatggtaaaagtatggatatttctaaatatatgatttcaggacagaatttttaaacttctactcatggatttgactttatgtatagcagatgaatatacgtgttgtccatgatcagagttccatgaaaatgaaattaaaatggtcacttataggtgtttttactttcatttcttaactgcgtagactaatgacatatacatcagtcgaactttgctttctaattttaaaggcagatgttaatactgttagctcatgaagtattttaaataatagttttatgtattcagctatgcataaacctatatgcatattttgtgggatctgtgaattgggtaaagatttgagggaaagtttgcagaaatgagtatgatacaaagtgaattttagggttttatatcaacttaaccattgtgcaaatttgagttttatctaaatcaagctagaatgattcactgaaaactctgtttttagtatcattaaagcaatgttcacttgcgttattcagaccactctctggagaaagtagaaaggagagcctatgacatcccatgaagtttggaggcagttaagaccactatgtttacctgaactctttcctatgtttaattaaacatagagtcagatgtttccttttccatggactttggaaaaatttataactgatttgactattttaggaatcttgaaatcatacactcctcatagaacctccttcagaaaattacatatatcattgctattagtttggaaaatctgttagttaaaaatgtttttatattaaccaaaaatatagctactttaatttagagcacttgattttaatagatgtgctaatcaatggagcagaagagttaactgagttcagagacatagtttgggtattgccttagagatatatctatttgttgtatgtatgcttaaaaatacccatgatattattttattcatacattagaaatatttcctactatcgatttttctcagaatttttctacagggattcaggctacgtttcttttgaaatgtcaatgattgagaacttaggtttaaaaaaaattacctaaatctttaaagttaaaaaagatgaacatatagtttattcatacaatgaaacattatttggtggacatacatttgaatagattgtagctaaaataaagatgaattacaggattataacatggagagaaaaatgcaagttgtagaagacagcatagagtatggttccatttttgtaaagctcaaatagaataaaaactaagctatgttttatttagcaatatacaaataggttgtaaagctgcttttaaagagcaggcaagaagaatggtaaacacaaaatcaggatcatgcccccagaagggaggcaaggggctgatgttggggagaaagtaggtaatggcaatattctaggattcaaattggatcacaagagttagtgttatcattatatttcatagcttacataaacatttattttggatgcatcaaatactatataatagaaaaaagtagaagacaataattttctgcctgtttgtcattgtatatgctttaaaagaaagtaatgaagtaggaaatttagacaattagatggttgttatgtctacatgagaccaaataatagccttactgattattattatttttttttttggaaggactaagtaatcctgttttaaagattcatgttttaagtttcactacttaatttttatttcagtgacaggaccaattcagaccaggttaaagtttataagagaaaaataaatataacaaatgtttattgacttcccacactacctgtcaggtagtatattgggtgttgctaaggtatcacagtaaatgagataagtttctgctctttgagacctttaagttcagtgaaaacaagaggataaatgtgtctattaatccaattagtacaaattctgaaagcacaaaatgttaaataaattaaggacgttcctgagactaagtcatccctcaatattattagaaaatgtgataaagcaaagcttaatataacagattatatagaaaatattgatttttttgttaattttgtctaatttctctttgctttatttcataagcttatatattatcctacccttaggagttttcttgtcaagatactaagatgttaaggcaaatgcatcaattccatgaagtaactgttacatagcttattacagagaaatctttatgcttatgcagagatccttggcctggataacattataattatttttatttaatccttctccttcctaggaaatcagtttgatatgttgaaaagagtgtcatattttagagaaactttgaattccatttctgatatgtttcattccatctttaggactttaggtaaattagttaactttgccaagtgtgaattttccatctataaaatggtgttgtaggctgggcgtggtggctcacgcctgtaatctcagcacttcgggaggccgaggtgggtggatcatgagggcaggagatcgagaccatcctggctaacacggtgaaaccccgtctctactaagaaaatacaaaaaaataagctgggcatgggggcgggcacctgtagtcacagctactcgggaggctgagtcaggagaatggcgtcaaccagggaggcggagcttgcagtgagccgagatcatgccactgcactccagtctgggtgacagagcgagactctgtctcaaaaaaaaaaaaaaaaaaaatggagctaataatattgtccagatagagctgtgaggattaaattttataatgtacacagacaccttaccaacttgaccacagtggttattatgtgtctaaatccaggatagtgctaagtaggatttaaggccacttaaagataaggccttcagtgtatgcaaattggatttgttttactgagcgattaatttcctagtcctagaacattgtgtgtgctgagttactgaatttttaaatgaattaactattaaaacctgaaggtcgaaagtgtttcaagacagctctccaattcaactcatagaaaatatcttttgaaacaaaatgtgctgccatcttcttatcctgaattgaaagcttaggaagaaattgtggagacactcagaagtctgccttgtttctctagtctgggatggaatttctgcctggaaattttccaggtagaagatgaagaatctggaaaattttccatatgtgtctgagttagatattaatgttggctttgttatttagttcagagtcttgcttgtaaattccaaaacatcaagggtattcataatcaaatagaaagcaacacatggattccaaatgatatttggattattcacaaattggtattttctgctctcttactttgctttcttagtatgaatcatgggagttgactgtagaaatgtcactattgtatgcagaacacatttcagtctcttcctctcatctattctgttcaaaatttttcaaaaaagaaccaaatattcataaagtattttaaatttatgtagtttgattttttgctacttgtttaagaaataaatgtgaatttctgtgaaatatgcatttatttaattaactggctaaatttttctgtcatttaaagtatacttctaaatttttttaaattccacttaaaataagatttcaatttttaaagagatataggtaaacatttcaatgacattaaagtgcttatttcttaagcaaaggattggaatgttttggttctattgggcaaacatgtccataaaaagtggcttttgtttttggtaggagagtgagggcttccacaggtttacagaagaagtgttgtcaagggttcagctatggaaagagatgggaggcttatcatgcaaggatgcactagagtgggtatgatggcgattttctcaggcttctggtggtcatggttgaaatgttgctgtagcacttccaatcccatcatcttaaggttttctgaaactgcctttgttcccacattctcagcaaaagtgtaattgtgttgtattggctcacaatcattttgtttggctatgtcagatcatgatcccagttggggagttttttttttttttttttttttttttttttgagattgagtctcacactgtaggctgggctggagtgcagtggcatgatctcggctcaatgcaacctcttcctcctgggttcaagtgattctcctgcctcagcctcccgagtagctgggattacaggcacctgccaccatgcccagctaattttttgtacttttagtagagacggggattcaccatgttggccaggctggtcttgaactcctggcctcctgattcacctgcctcagcctcccaaagtgctgggattacaggcatgagccaccatgtctggccaggaggagatctttaaacaaaaaaatagggctgctattactaaaaaaaaggatagtggataccaggcaggcaataaataatatccaatagactacgatatataaaaaagaacaaaatgatcggccaaaagatgagatgttatgcttttttataacacaaagcatggggagactttatcaaatcacatgttgcattaagtggtaacattacaggaaacttgtaggactttttacaaacatccagttatctgggctttagggaagttgctctagcaccaggtaaatatcttttggaactgggaattctgatgttaagtagcttacaacaaaataaatactttaggaatttatccttggaaattctctatcccaataacaaatcattacactttaatttgaccatagatctcatccatgtatgcagtttaattggaaagtactggataagatttacatgactcggcttcttgacatttaactaccaagtttcttggtcttggcttccttgttccttaagtgaggctgtcagtgaagatctttaagatgccttacagttctgtaaaatattataattagattgctctgagtggcacaaataaaattaaggtttagcacagtaaaatctgttatagagagaggtgaagtttatttaatctttatttaaaatgtatgtatacatctcatataactcaatatattaagcattttggacacccaaatgtataaaatatatgaataataaatttatattattagaaaaacaaatataaaaagattattgtcttaacatttctttgtaaggaaataacgaaactcaaatagaaaatggtagttttatcgcttctcagcctattggctaagatcaagtgaaaatggtagttctgatttctaagatcattttaaattatagttatatgataaaacaacattcaagataatttagataatcatatatgatttgtttttatgttggttaaaatgattagcttggaaaatggttcagattagtgtggaattttttatgaactcacctatgatcaatgactgaatttgaattgagtttatagaacaattattggtattttcaactaagtattgttgtacagtaaagcagagctagtgagatacccaatggaaacagcatctaaaaagttggtctccagaagtatcatttatacaaatattcttctaaaagctttatcactgaatacctctatttgtaaaaaaagatacatacatatatatatatatatatacacacatacatgaatacttaaaatatctttaaggatactgccattatattcatttattaattatatacctgttctatattatatgcattataaaatatgtaaggtataaaattaaaagaataagataaagattaaataataaacttagtttcattcatggtatgtttatatggtatggtatatgtatatacagtatggtatttttgttttggctaaaacagaaataggtaatgcaattgagtatgaaccattattttttaaaaatttgttaaacattttgaattgtagaagatctgattctatagtttgatttattgattttaatggctgtatgactgaaaaatgcttcctcacaaaaatatatagatctaagtggaaaataaattgttggctaaaaattatgccaacatttttaatgaaattcaactgatgcatttccatctcacttgaagttaatcagttattcttgtaaagtagccacatgatgctaaacttaaacatttctggcaaatgtgttcaaaatgctgtcaaatatgtcaataattaaaatatttctaaacatccacttttacgacattctcttcatagtattaactttttttcaatcaacaactttttttttctttttgccataaaataatcagcaaagctctgtgtggcataaatggcgtttatgatcacctacatctcaatactaagtattataaagaatcattatattttaaatgtcgttttcaagaaattcactcctttaataacattgtcacacttaagaaaatttctagcttcaagttttgtcacaatatctttcctatgattactgtaaataatgattttcatgtgtgtagtactactactattttcttgctttgctgtttttttcttgtctgacaccctctcacttgttacagtctttccattaaatattattattttatttttattttaatatttcaagagatttattctaagccaaatatgagtgaccatggcccatgacgcagcctccaggaagtcttgagaacatgtacccaaagtggttggggtgcagcttggttttatacacttcagagaggcatgagacatcaatcaaatacatttaagaaatacattggtttggtccagaaaggcggaacaactcaaaggggtgtgagaggttccaggctatggtgaatttaaatattttctgtttgacaattggttgagtttttctaaagacccaggattgataaaaaggtaatgttcagcttaaaaataaagattgtgcagcacaaagttcttttgaagtcttatagtggctgtccttagagacaataggatgacagatgtttcctgtttagattttaggtaatctctttaggattgggagtgtctggaagaaaaagatctagctatgttaatacagattcttcatagatgcaaatttttccccacaaagaacagctttgcaggggcatttcaaaatatggctaagaagcatgtttttgagtaaaatattttgatgttcttctttatcttgtaatattatgccagagtcaggttggaaagtaaataatgatatatagggttaaataaaacccaacctgtctgatgcgaatttgtgatttgtaggccatgactccccagacaccttagataggagtaagtccttaccagaatttgtgagatatgattaaagtagtgctgtgagagaaatgtttatccttaataacttatattagcaataaaactatgatcattggtcagataagtatttatcttaaaacattatattaattgaacaggagagtaaatccaatgaattaaaaaggaagagataatacaaatgaaagtgaaagttagtacaatagggaaaaaatgataaggtagagatcaacaaatcaaaaaatttgttctttggaaacaaatcaacaaaatagacaaattgcttgcaagaccgatcaagagaagaaaagagatcacagaaataaacaattttatgaatgaaaagttgagcacagccctaagtagagattacaagataaccaaaggtaattataagatgcataggtagttcaattggggaaggataatcttttcaacaaatagtgctgaaacaactgaatatctgtattttttaaaaagaaaactttgattcttatatcataccctgcataaaaattaactccagatgaatcatagacacaagtgatatggctccaacgattggaggaacaccagggttcttggtcctcatgccagtttagataaaacgacacggacacacatggagtggttttaaggagcagatagtttaatagccaagaaggaagaagaaagcagaaggaagaggctcccccatatggagacagggaagggagagggggatccagagccgaaagaggaggtcccccttaaatattattttttaaagaactcatttaatgttaaacttataatttctctaatatagttttccttttagggttaatagtaaaaagcaaaatatcatatatttccttatttaaaaattgaatatcccaatctaaactatatagaaacactggtgttttgagctagctgtgtagcaattctaccatttatgaaagagtgaaagtggaatagaacaagatcataatgttaaattaccccttcaacaaagatatgcactgtggaaatgtataaagtgatgataacatgtctctttaagtttttttgagaataaagtaaggtcgctgttttatgtagactcatagaaatattgaaattctaaaacgacatggtataatttttgaagaaatcttcagttcctgaaagagggtagaacagaggatgttttctttttattttatttttccagaggttattggggtacgggaggtacttggttacatgagtaagttttttattggtgatttgcaagattttagtgcacccatcacccaaacagtatacactgcatcatatttatagtcttttatcctttgcctccctcccactcttcccgccaagtccccagagtccactgtatcattgttatgcctttgcatcctcatagcttagcttccacatattagtgagaacatacaatgtttggtttttcctttcctgacttacatcacttagaataatagtctccaatctcatccagctcactgtaaatgctgttaattcattcctttttatggctgtataggattccatcaaatatttatacacacacacatacacacaccacagtttctttatccactggctgattgatgggcatttgggttggttccacaattttgcagttgtgaattgtgctgctataaacatgtatgtacaagtattttttaagaataatgatgtcttttcctctgggtagatacccagtagtgggattgctggattaaacagtagttctacttttagttctttaaggaagctccacacggttttctatagtggctgtactagtttacattcccaccagcagtgtagaagtgttccctgtttaccacatccacgccaacatgtactgtttattgatttttgattatggccattcttgcaggaataaggtggtatcccattgtggctttaacttacatttccctgattattaatgatgttgagcattttttcatatgtttgttggccatttgtacatcttcttttgagaattgtctattcatatccttaacccactttttgatgggattgtttgtttttatcttaccgatttgtttgagtttgttgtagattatggatattagtcctttatcagaggtacagattgtgaagattttctcccactctgtgggttgtctgtttactctgctgactgttccttttgccatgcaaaagctctttagtttaattaggtcccagctatttatctttgttttcactgcatttgcttttggattcttgaccatgaaatccttgcctaagccaatgtctgcaagggttttttcaatgttatcttctagaacttttatagtttcaagtcttaggtttaagtccttaatccatcttgagttgagatgatataaacaaatggaaacacatcccatgctcatggagggatagaatcaatattgtgaaaatgaccatactgccaaaagcaatctacacattcaatgcaatccccatcagaatgccaccatcattcttcacagaattagaaaaaacaattctaaaatttatatgggacctaaaaagaagccgcatagccaaagcaagactaagcaaaaagaacaaatctggagacatcacactaccagatttcaaactattctataaggccatagtcaccaaaagagtgtgatactggtataaaaatgggcacatagaccaatggaacagaacagagaaccagaaagaaagccaagtacttaacagccaactgatctttgacaaagcaaacaaaaacataaagtggggaaagggcaccctttttaacaaatgatactgggataattggctaaccacatgtaggagaatgaaactggatcctcatctctcaccttatacaaaaatcaactcaaaatatggattaaggacttaaacctaagacctgagaatgttttcttaatggtacagtaatcctttacagtttaaataaactaaaaggaaactgcctataatttatacactgttcatttatatgcatgtagctataataaaatatagactttcatagattcagttagaaatttggctgccttcccagcaaaaggcaagtatataaaaactgaatatcctcatctgtttaacaagttggccttgtcaacccttaatatatatatatgttcagtgataacacatctttttactatgttggaaaaattcatatgctgaaacacagtctatgttttgacactgataattaacagtatgtatttttgtattcccagctagacttctttcatggagcaaattgggcaaattctcaggtcactacataggcaatagtctattgccttattttctggatatgttttctgttctctgctctaattgaatacattaaattaaggtacttatcttcatcacttttaattttttatttaacaaatcttcatatttaataggaaacattataatgctaaatggcagactttgtgggagggcataaaaatgtgaaggacagccagcatgttgtagaggaagaaaaaagacaggcttaaaaccaggccacctctgaacctgaaacccagacttgtcacttacttgctgtaaaactttaagaaagtcacttatcttgcataagtctctgttttcacactgagaaaggaggttaagtgttaagcgaattatattgtttgaaatggggtgctcctgcaccctttgatagctcagctggtagagcgaaggaccgtagactatagagacatctgtgaaatgcggtggtcctcacagtagacgatcaagaatttttacctgtatcttacagaagaagaacatttgagataattaatttttttttagcttttactaaaataataaatatagtatttatcttgtgtaggaaatttaagcattgcacaaaaggtccccaactagagatatactgtactttaaaacaagcagcataatgtgcttccatcaggcaatagacaagtaggcaaaaacatatttgacttttaggcctctgctttgattactgaaaatgtgttgccttctaagcagatatttagtaatatttgtttcttctacagtggtgtgcaacaacagttgtgatttgactcattgcctttcagttcctcaagcaatatttggctatgtaataaagaagcttattaggctaacggtattttaaaagatgtttagggaaagagtcaatgttggtcttggtagtcatagcacatactaaccctatggtcttttacagctctcatacttatgaattgaattgactccttggtgtctgttaaccaccataccattatgtgaataatttcattgcagcctttccaacttaaagctaatcttttttaaacatgaaaaataacttttatctctcacaaataagctattatgaatgttttgagaccccaagtgtttttgagttattaaaattgtaagatggagcatttattggaatgcgttttgtttaagactaatatgttggcaataaagttaaaaaaaagtgctatggcaagtgtttgcttaattttagttagagagaaaaacagtcactgttaatgtattatagcatttaatgacacttcggtgtgtgataaaagcaaaaagtactttccttagttaaaaagatgaaaatggctgactttcttatgtactctgaacttcttgcatatataattttctttttttaaaggtgtaatctgtcagctaatcagcaaagatttattgtacaccttttctgcagtgtatactgtgctagttgttacgcagaataagtaagacaaggtaagtggcttcccatcatattggagaggcaatcaattttctatgtgaaacagatagtaatattagctgatgtatgagtaagtgacaaaattaaaggtaccaaatagcatgtcccagtgtattctatgaaacattatttctttgaaatgatctgggaaaaagattctacagccaaatgtgtttgagaaacgtggcccactatatagctcttttaaagatttacagcatactctagcatattaaggggtctgaggaggcctgcaataaagatgcctataaaagttacttgactaagcaattttccaagcttatttggtcgatgtcctgaatatctcctacaggaacccactttaggaagtgctccttgatttagaatctgacccaacagagtgtccccttaaagggtggaaaaagcttgctttttaagactaaatgctgatttttaaacaagtgttacatttatagatgcattattgattccagtcgagactgttagaactttcaggaggaaaacttggcaagacatgtaagagtataaaatataaatgctctttagcttaggaattacacttctagaatttactcttgttcaaaagattttaatggctaagccttgcctctgaactaagaataatctcgtcagcctgccatttaatatcttccacaacatttccttactacaatttcgggtatactagcatgcacaaatatgtgctatataaatgaagagtagagacatatttacagaggctagaaagtttggaaaaagattcatggagagggtggaacataaagcagccctaatggcgcattgcggagttaaacgtgtgtgtgtgtgtgtgtgtgtgtgtgtgtgtgtgtgtgtgtgtgtttgcgctggtgatactactctatctcaggcagggttctaagtactttattacattatttcatttcacaaaaccaacccatgatatgaatactactatttttcttttttattgacatgaagagacagatttcacagtgttccttgagtcacactgccagtgaaagtttgagattggtaaacccattttagagcctgaaatttagctacgttgttttattgtgaccagaatattttctaattaagtcccagaatacaaaatatcttataaatcttgagagaaagtgggattttttttccccattgtactgaaatttacattatttgattgagtttttgatggatataaaaataggagaaattatgaaccattgccggtacttaaattgtaactgtacatatgcatacaaaaaaatcagactatgtaaattctgaacttctcttggttggaggtggaaccagttaaactgagtatctgcaccttcacatttgactctgttaaataattttatggtttccaacatgggtaggatacatacagagaagttttgatgacttgcctatttgttttcttttaccatataatcagtaagaattgagattaaggcatggtttgtgaagcaagctaatctatccactctccacagaaggatacatgagaaggacatctatcttaagacattgactggaagacatagattgtctcaaaatcacaaagaccctaagggcattccaaaattattttttcacatttttagtccattcttattaataaactgtaaataatgatagtgtatggaataatcaattacatgataaatcttctttttattataaatggaagagaaatatttttcattgcacaaaattctaaaggatttttttcaaactttttcttaaatgtattagttaactgctattatcttaggaaaatttcttccttaattttgaatgtctttattatttgttttttctttcatgcattaggctaatacctgaagtattacattatatattacaatatatattacattatatattacattatatattatttcagtaagcctcagaaataatatgtaatatataaagaggacagagtagctattaataaacagccattatgcattcaatattttaggtgttggatatccaaatgagaagaggaagtaaaagacatataaggaatagagaacaatcaaaacattggttgttttatgtttttaaagctctcaaatctcattgaatgcagtaaactgaccaagaacttcttgtttatctggtatccagtttcatttggcattgtgcggcgacttctttctgagaaaatagcagaaaatctgaagaattttaaaactacaaacaaaagccaagtgatgacatagatttagtagaacataacacaacctcctaacctcctaaatattctctataatacaatgctatgcaatggcacatgacatgattgcagtgccatgatgcagagcaatgtcttgcggtctcagagaaaaaagtcaattttatgtatgattgttttcatggaaaatatattcaactcaaagttttcaaaattgctaatttatatatgcatttgtatattatattttttatacataggaagttgaatatccaggttaaaaaaacatttaaaagaaaattagttggtcgagcaaaagaagcaaatgtgtaatatttgaccatgccagtttttcgttatttacctaattatgtatatgagttttcaaaaattagaacttccagattaaaaagtttgtaaccattttctatagtttctctaaagaaatgaaagcataaaaattacagtttcaaagataaatgtcaatcttaatttctagtacctggaatttccacatttatttttgcgggaaaaagaaaactattgtatatagtaaaccttaatgtgctttaatagactttgtattgtgttttaatagcaggtctatttattgagatttattgaaaataaaactattaagacaattaactttataagctaatccatacttacaatattttttctatgtttcaaaaagtattatttttgaaattatttgtttcagaaattaaccatttaaagcatgttcatgcatatcttcatttgtggtcttttgttatgtctgttctcaaatcttgtactatattaattggcaacattaatctgtttccacaataattatagttttaaaatttcttttgttcaagatttaaaaatttgtaaaacattgctagtgtttatcagaatttgaatagcgtaaaatttttttaataataatatgaaataaagtaaaataagatactttttactttaaaacaattatgcagaggataattgttgtctagttttcttaatagtaaattagatttatttttaattaagttgtggttgtacattggtgtaaaatgtctgttccttcccccttatatttttctggtttatgcactcagaagataggaaataaccaaatagaaaaagttcagctttattttatttatgtataaaataagaatgtttaatcttccagaaaaatgcattgtttggatttagtttattatctaaacagtaaagcaagatatttaatgtaagcaagtttttctatttaaagaaattagtaattatttcaggcatttgtttttaatgaatattttgaaggtattatggagatactttctccttaagttgcataactgtacattcaatatataccttgcatctctttagcagttatcaaaattttagggctaaaagaccactttgaacaaaatttctagaaactcgttacttacatgctttagcagaaatttaaatcatgaagttaaatctactcagtttctcaaaagcacctgttatctctgacccaaggcctttgtcacagttgattcttttgcttaacacagcagctcttctcccctttcctgctcttttcatttagctaatcactgtttctccttttgagtctctgtgtattaatccagataggttatgttatgatgcattaaaacaaaaagactaaatcttagtgacttggcataacaagctttttattctcattcacacaagcctatcgtggattgacatgtctgtctgtcatgaactgctgtcattaatgtgtcgctttccagttgttccatcttgtgatacttccatcttaacatgtaacccttcaatagctgcacagagaaagacagcatgaaaaatcatgcaacacttttaaagtacttatttctggaagtataatttgcccaagtattcaagaagaagaaggttggtgggcattagtcatgtccactaaaccttgcataaatgaaacattttcttgtctttttttgatctctgttctgccctcagccttctccagatgctctcataaccacgtgttctttctttttcatagtcattattataatgaattgtttgtctaacttttccccttctacattgtaagctccatggctccatgacttctgtgactacatctgctttttctctccactttgtccacattaactggcaaacagtaaccagccaaatatatttattatatattaaatatatatgtgttatatatttaatctatttattaaattaatgaactaatgagtttctatggcttgcaatcttccagttagagtgctaaatgcttaagttggatttatgttgatttcttttggatctcccatggtttcatgtatgattttcacatggtatgcaacaaataaattattaatgtatgaatcaagtatatatttagaacatcttatatgcttgacctattttgaggaaatccatcttagggaattattatctctcagtataagtaagagaaaacttcgacttttggcagccagaaataatttttccatgatatttttgtcaacctcctccctcacccaattaacaaaacccttattatagacctaccatggtaaagacgatgctaggaatttgctggaggaaaaatgggagaagacaattcaaaggaatgaggcatgatctctgtcctcaaagagatgaccatctctatctgttagggataagatgtacatataactgttgaaggaagaagtagaagtacagcataagggatacacactgggactatgaattctggatcatgaactgtatcttaaagctaggaatatccaggaaaattttatgaatgaagtaacatttgatctgggccgtaaatgcttgggcacattgaaaagggcagaagaccattccaaactgatgaaagtataaagatcttctactatatctacattgattaagtaggtgtagaaacataaatagtgcccatcagcattctaagttctctttccttgactacaaaaatagaacataatgactcctaagtctttttttttttttttttttgatggagtctcactctgtcgcctaggctagaatgcagtggcattatctgggctcactgcaacctccatctcctgggttcaagcgattccactgcctcagcctcccaaatagctgggattacaggtgctcaccagcacgtgtggctaatttttatagttttttagtggagatggggtttcaccatattggtcgggctggcctcgaacccctgacctcaagcgatccacccgccttggcctcccacagtgctgggattacaggcgtgagccaccacacccagctgattcctaggtctttttatgctaggtagggtcatgtgactaattcagatcaatgagctctgtttgataatggtgtttattgtttctgggacaaattatgaaagaagcttgaattttatacttgatttttccataattccttctcacatcttcaataaatttgaagctttatgttgagaaagggtgtcataacatgatagggaatccatcaacatagatccttgccaatatgaatcagaagtgttgcagcatgagtaagaaataaaccacttttgcctaaaaccactggtttttgggttttattgttaccatagcatattcgagtctatcctgaccaacagtagaaatatagtcaatgccccattttatatatatatatatatatcaatcacagatatataatttctaagggagttggtgttagaaaattaagatacaactcaagtttattcactataggtgtgtctgacacattgtgcttctagttcactctctgtctttctcctttaaatctaagactatgagatttaatagatatgtagaagaaacccaaggcccacatagtgtgatgcccaaatagtagacagtaagtagactgctaattgtttggctaacatttgatcaccttgctccacaatattttacaaattgattcctcctcacattagtcagaaagaaacttaagacttgcatgttcgttttttttttttttttcttcttttttctttgaggtggagtttcgctcttgttgcccaggctggagtgcaatggcgtgatcttggctcactgcaacttccgcctcctgggttcaaacgattctccaacctcagacttccgagtagctgggattacaggcacctgacactacgcctggctaattttttgtatttttagtagagatggggtttccccatgttggccaagctggtctcgaactcctgacttcaggcgatctacccacctcggcctcccaaagtgctgagattacaggtgtgagccaccacactgagcccccacttgcgtgttcttgaaagcagtatgaaacattcaactcaccagtctaattggagtttttgtctatatgataccaaattattgataggcttttaagaactgaagtgatatagtttgatataaagcagatgagaagttacattaaagaagcttatgcaaacatacatttaaatgttagtctaagaagaacacactttaactgctctttctcacatattcaattacacaaaaatgatagtttatgtttaggagggatctatattatcagtaggatgaatactcatcttggaggctaatatttgtggtcagctgtatgggttaagacagctatgtgagttacggaatctaaggtttcagtattctgatgattatggtggtgtgtgagttcttggtaatggaaacaaattataaccttttaaccttttggaaaattgagtcctatgatatcagatgtgtaggaaacagtaaaaataggggaaaacacatccagtgcaacatataggatcttagttaacaattctctccttattttcaaacacctgatacatttaaaggacccattcttgaattttaggtaagaacaaactgctgaaatcattcatatagttttatacttgggttttaatttccttatgcgttaggatgagtcaaacttccttgtttcacagcccccactttataaaaaataagttcgctgtgaatttcaaacatgacctgagtgaacaactttatgaaaataatgtgcatgtgtaattacatgctgtcaattctgttacatgagggaggattatccagtttgcatattaatcacgctcacaatttcctactttctcttctgagtacaatgctgttgtaaggactgtatactgtgatgaataaaatggaaggaaacagacactacctgtgctgtagaaggtgtgacagggtgaagaataaaatgggagtaaagtatagcaacatatatcaggatcatagagatcagcgtggataaaccagaagatgcgactgaaatgatgtctggaaagagcagcagagcagaattgattcctagatgtatactgagaccaactgctctatctgtccgacctcagtgcagatggctcactgtgtgttatccttcacaatcacccttgacttcaattcagaaaagaaaaaaccttaatcactgtgatcattattaatattattaatagggtattgatttgcttctgtttttgctcttgtaacacaattcatgatttggcaactctaggacttttaaaacctgatactaattgatagaatttttaaaaatagaaattggatgggagagttaggctagaattgctaataattagagtatatttagaaaactatatgcatttgcttattttttaatgttaaactagaaaaaataaacataaattagttttaatacctttgctgagataacttgttgggtaatcaaaaatcacaaaatgtagctggtttattatattctctcaccttaaatgtggcagattaattaagggctgatatattggttagcactaattttctaacttcagttgtgtagctgatgaagtttcattttcctctaaatgggtgatgctataaggaagggtggtagagcttaatgctgcctgtcacttcttaccatacagagggaaagaaaggatatgatcaccagtcaaaaaaggaagctacaggttgtagttctcatctctgtacacaggttgtagcataaactgatacaaagaagtaagtggaatcacccccttagcccatgggccccatagaaagcggaatactctcccggggttcggaggaggcaacacttctaccaggttccaacagatgcacaccatgggtcctgtagaaagctgaatcctctccgggggttcagaggaggcaacacttctcctagcaggttccaacgggtgtacatcagtgtcacagacatggcctgtctcccatacccttaggctattccagaatgaatgttttcatgtccttttattgttgcttccagcaaagtctggccctaccctttcagagagtggacagattataaacactaggcatctgatcatattaaaggttgcagggagatctgagtctcaaaccctgctgccccactgcaggaaaaacaatctgctcatccttttagaaaagttaactctagatcagtcacatgtttaaacacagtactgtcatccaaatgaaaactgctatgttattattcttttttcctaaagtgcttgctaaaacacagaaaactgctgtatcataatcaaattccaccaatcaattttcagattagaggcccatagcctttacttccttcagaaacaaaagaaaggaggtctcataacaatgattaggaggtttcaggatcccccaaagctcaccaaaaaaggacagtctgagatacctcttatcaaggcagatatattatgatcatgagatatttggaactaaaattaaagtgtcaattttcagttaaaaacggaagtgatgtagtttgaaattgtttttatttccgaacatgtcaaccacttctcgactttgtgattttgataaatgtcagcctcacctgtttgtttccttggctttgtgggttgtagcaagctgtgcacagtggtttttctggtgtttttcagatctcatcagaagatgccagaagtggtcatcttaagagcttgttcaagggctatactttagaggtacagtctagtatgcacaacccagtagaattatctggaaaataataggaaaataggtgttcttttcttatctatccactctttttctctaagaaaattttggcaagagagagaactggtggatgattttgttttttatttttccttgtagaccaaggaaaatagttaattcttgagtggttaattattccaaaggacagatgtgttccaacaaatcatggaggggtggcatggatttgtagggtctgtgggctatggcataggactgctgggttcatatcccagctttaccacttagtgtgctgtgtgagttgctgaacctactttaactcaatttcttcaactgtaagatgtgtataatcatagagttcttgcaaagaagaattaaatcttgagttagctaattaatacagagtgcttagactggtgctggcactaagcaagcatctagtaaatattagctattatcattacaggtccacagtcactcatgtaaaacatgtggggccagatgagttttggagttaagaatattttagattttagaagttatgtatactctatattatataacacccactataggatttggggtagaaactcttaaacactttaatatttccacagccaagtctgtaaaatagttacattatgtgggaagaataaaaactataattagctcaggtcaattaaggttaggttttgctatgaaatgagctagcaatttttttttgttcagactttttaggttttcaaatttcaggtaaggaactgtgaaactctattatattttctgatgttcctgagccaaacctgactctaccatagaatgacaagcatccataaggatgggaacaaacacacctctgcagttttcaaagtgttactggctcaggctcactttcgggcaagccggcttatatcagggtcctagtgttcaattagaactgaacagagatcacacataaaacaataaggtttagttaaatggttgacttgaaattctaaagaagaaaataccaaatctgcttcctaattatgatatgtccagaaaccataactcattttgtccttttcctccattccctatatgcagtacatgatgatactacagactcatagcattcttttggttaagaaatttaagatgaggaagggattttctgtacaatgcaactggcaatgagaaaagacaacttgctaaaatatgaggttgagtgatcttatggcttagcctatgaatatcttctcttaaaggcaaaatccatgcctttcactctgtctgataagtggtccagatggagtattaagctgaatttctttctcattaacaaaaagtaggagtgcctaggaaccccatgcctgcagaaattgaacttgagttattattcacttcttatatctctttaaatttcaaaattattttgggatctactgaccatggcaaaactcaaaatatagtttacacaattcagtttatgtgtctccagtttttcagctttcctacagcagagcatcatcagtgaatgaactttgtagaattttgcttggcatttagaggaatgatagctaaatgaatgtattctcacccgataattccattatagtctccaaggctcaccactcattaattgcttctctaattgctttatgagaaattgctatttgataggtttttctccttattctttctaatgtcgttgagagttgctaatttacttactagataatttaggataagttacataatttatttgagcatttacaaataatttcaacatgctgaatgctgaattgcccttgtgatatagtgtgctctgttgatctattttttgatattcattaattcaaccatttattctacaaacaagttttgaatgtttataatgtgcgaggcatcgatccaacaactgtggaatctataaagagggttggtgtcctaaaggagcttatattctattagggaaagaagactgaaataattagaatccaaggttgaaagtgatgaatgcagaggcctggacaaagtcctatgggaattcagaagaaggatggagattatttctagctggggaatttgaaaatggtttaacagaagaaattgtcttagcagtatatcaaaggataaatacaattcatttttattaacaattgattaaagtattgccttttgttgtccatcaagggaagactgcttaggtaaataatggcacttctaaaattagagagacattaaaaaatatgtaacagccagtataatgtatacactgacaattcagagtagatgtttgactttttaggatggacagatgccagcctgtatcctcttctggtacatgctgactacatattgagtctatatacagtggaatatgtggaagtaaaatgatgattcaaataacattttttaaacctggataactgcaacatgctggtgcattaaagagagcaagataagcaacaaaagttataaagtatgaattatttgtatataattgtttgcatatatttaaatctagagaattgtcttagtttgaattgtaaaatttcaaatgagttttacctattctttgcatttttctgtttgagtcatttacagcgactatgaatcaattttataaaagaaacaaagtattttaaaagccatgtcaaaaaacattctgaacaatatttaaacagatacattagtgaaaaacataacaattagaaggaaattatagctatgtataggttatgtattcacgaaaataatctagttggtggaagcagaaatgagataaaaataaggtggatacatatggatgaaataaagttggaaactagttgttggcagatcctggaaaaccttgaagaatacaaatttggctttatctaataggcaagtatggatgggggcagttgcagtttttgaatgagtaatgattactgagaagcccttatttagaagtttttctggaaacaacctttagaagaaatttttggtgactgacactggaattatggatgacatttaagaggttactgcaataatctacagaggcaaacatgacatggaatttgacagtagcatcaggaatgaaagtgcagcagagacaccataagtttttttggagggagaatgaacagaacttacagactgaaagggtaaggaaggcaaaggggaggaaagagccattgacgaatactggtagcattagcttaaataaagcaatttcaaaagagctacacattagtgataaaggttcagagaatcggaatgtgagatctgaaagtgatcatttttattcctcttatttcattgtatgtaggaaaacaaaactgaggttaagcaatttatcaaaagttatacagttaaagcttcagttggttttagacttatcagtttgaagtgccatagagtatcccaggatatctgataaacccattagaaatacggatcaagagctctgtcaagtcccatcttttcctttagtcaaaattgaagactcctccatagtcccatataattatacatacttctaatatagaatttacaaaattttatttgcttttattgttttcctccaaaagaaaaggaccaggtctcatcgtatatacgtatacataggcatacatatatatggctatgtatatataactggtactgattataggcgctcaaaattgtttaaatgaataaatgaaaaagaaaagtgacaagtaacatatatttgagagtctttctagaagttgttatagaagataaggtagttgaagtcctcaaaggagactgtataattacaatagaacctccttctcctgcttgagatatccacctatgtggatataggtatataggtttataacctattaccagagacttccaaatgaaagggcagtctcttttttgtattacagataagccaaatggcattatgaatagttcccttaaatcaaggattatgacactgaatgcatcatgcctctccacatgcagtctgtttctcctccctaagccctatcttggttaatagcaccattatccaggctatcagaaatctgaatgttgagctatcctcgtgtcctaaatctgatccttgttctatcagatttacttcctgaacatctcacaagtggatacctcattctgcccccatgatctcctactgctactcgttgattccaggtctcataattgctcttggaacattgcaataacttaccaagttgtcttcttggctccagttttatctatatcccaaagcccattagaaaacaaaattgtctttataaaacctaagtattgtttttatttttctctttaacaaatgctgcaaagactctcaatttctcaggttacaaatcatactcttttctgtggtggggtgccgtttgtgttttggtctatctatctaatttcaatgctcttccacttactgctccaactacattcacctaatcacagctcctcaaacactccatgctgttttgaagctggttacttcctttctctataatgctctttcttctattctgaagaattcccattcatctttagaacaagctcagttaacattcttatctgagtaacattttctaacatcacctgataggtctgatcactcctcttatgtaccttttgccatgtgttgtttccattatacattattgcatgtacatgcctgtggaacagaaaattatactataaattccgatagaatagagacttagttatttttagtcctgcaccaggtgcagatagcaaacatataataaatatttatcaccttttgcataaaagaatgatgtctggggagaccttttttttttttaaagttttatttgtgtccttaatataacacttttaggaaagagctgggaatagggacagatttcgaagtttaatgaataagatactaaagagtcagttttagtaaatgtggtaaaatatatgttatgatggaatacatacacacacacatacatatatgtatatatatataatggaatcttaaaaagaatctcagagtcctaaagagatcttagaagacctaaagaagtatatggaaaatcggaaataaaccaatgcaaaaatgcagacttgagtttaaagaagtgagaagacaacaaagaattaagatgaaaacagaaaggactttgtcttacacatttttatatctttagtgctgtgcagatagaatcattcaatatatttacatagaggaaagggatatgaggaaaagaaaggatgaaaaagacacagaagggaggctaaaataaataagttgaggaaatttatatttaaaacaaaatgaacaattaggttcaacttatctccaacttttccatgacattatcaacataggttctattcatccttagcttttagcatgcttatcatctataatcagactgtgaaactactttgaggccagtttatagaggtttttaaataccatgataagcactttgacttttagatctcttgtgcaggggatgctcttcctatttccttaaaataaatgccctttgggaagtgatgctttagttggattaagtttacctgactacaagaagtgagaaagtctccaagaagtgcaattaagaaggggtaatacaagtgtacaagcataaataacagtatagggattaatgtatcaattagaacaaaaaaaagcattgatgtatatcagagaaaaaaatagaaatttaaaatcagttaacttgtgggctgcaaaagaggcatgagtcaagtttgggagaaagattttttttcacactttgttgtaccctccctctgatgtcctttgtaaggtatcatagtgcctatgagaggatttttaatctacaaaactattcagagaaggcaagcctgttcagaaattttaaatggtcttttgatgtagctgagatgtcatgggaggctatcacaccttccatgctgacaatgccttaggccagtcatgctgatagggcagtgcagagacaatgtgaatcgtgctctgggtttgaatgtaagtgcctaggtacaagagttcagtgattttactatgcgacagccattgaaccacttattttcattatgaaggaaattaaacatctgccttcagaataaaataccatccatgactatccaggtatgctgttactggaattgattgaatatagctttataacatttcatatttattttgcatttgtctttttctagctgtgaatttctgattttgagtatcatacaccctctttcctttcataccttcatgcctcattgacattaaggggaaaaaatacagatttgagaagcaatacttacaaaagcatcgcaagcaggccaagataatacagatattttcctcaatcactaaagttatggattaagttaatcagaagcagcatttgtgatacacatagttttattttttttttttgaaatatacattttagtggtatttctagccttagtctgctttcagtagacagatccttgcaactatgcatctcctattatgaatgactggcatgagatttgtttgacattgctgactagacactggtattaaaaaacagtattcaatgttttcattttatgctttaatacagaaaagcttcagccaatttgtggtgtttagatttttgaggaagtaaataactttttaagttatgctgtttctaaatacactatttttgttttcttacccacagaatattatgtctacatctgattattgtgataagtggtttcaaagtcagcccaaatgatctaaaggaacctggttgttttgctagtcttttatgtgagatgcattcctaatgcaatctgtggaaactcttgtgaacattggcacagattgatgactatatgtacaaaattccacttagtggttttagttataagggctatttttaacaaagtttgaggaagacagtctatgtataattcctttgaagcatattatcctataaaccctcaaaaatggtagcatatctttgagctacgaaatgaatcattctaattgcactaaaacaacaaaactcaccaactaaaacgccatcaacaaaatcttagtatttttctctgacagagaataaaagttcaccatcataatgactttttttttcaaagcttttgatttttctttcctctttttttttcttactctaaaccagtaggtttataagccgtgtacttgaacagcaaagccatttgccatttggtagaactggctgacatttcattttttctgggcagattgcagattagtttgacattattttgctgagctctgtgctacatcattaacgtattgcttatgactaaaagcaaagtagtttcattttgtggcataataccctacactctctacaagtagcaaaaagtatgatttttctttgaaaatgactaggtattgcttcagtcttgtgaaaaaaaacagaattctattaatgtaacaaaatgtatcactaaaatggtgtgtcagaggggaacgaaaacctctataaaggcatgatgtgtttactgttgatatctctaaatcttggctagaaatgagaaacattcatgaaatattggacttaaactgagattacatcagtatggtagcaatatcgtacttgtcaactaacagaatataactgcttggttgtaccacatgaaaatgaaaattcactttttgatctaaggcataattcttttcctgtccatgttagataactttttgttttcaatgtaaataaagtagaggctagggaactgtatcacaggttggctttgtttgggaaatcgggaataacaaatggctgatcattttttaattaaagtggtaatcaaacaattaccaatgctcttatttcagttgttaatatatctgctcacatcctctttccccccactgaattaactctagtatgaaaaatttaaaaagccacattgtacaattgttgatttctttcctacttaaggagcaattgttgtattataattatatatgatatggatgagttatgttgaacaattcacttgctgtgatttttccctttttttcattatgttgacatattttatgaagacagaacatctcgttgctgcaaaatgctgcttttaatgacagtaagcacctaaacgaagtattgtgcaaatgttttggtcacacacaccttaatgtttaaacaaaacatcaaaccaattagcaagccatgcttcagagatactgtatatagcctgatagcaggttctaacgttttttaaaatctcattaaattgatgaacttaattcttcctacttttatggtagcagataggaaatcttgagggacaaacaataatttcacagtcatctgagattattacactgattaccttttattaattcaatttcccatttgtttctttgacattttgaaaggataaaaaagtttttttgtgtatgtgtgtgaacttgcttttgaagccccactatttctaataataaaaagcgttcagggatgatgtacattgcttcaacatactctattcatgttgtacgtcagagatgacttggtttctacagcgtcttagatagaaggctattaaaccagaaaaaaagtatgcaattttcaagaatgatttaaggcgtatctcttttttttgttccagcatgcttatcttctaattcaccctatatgttaggttttatctgaaggaaatctacacattcagttttctccagacacaaaatctaagagttggggtataaggggtaggaccacacaaaaagcaaaagacttagaaaagacattaacaaggattacatttctttgattataattatcttattgctattaggtttgttctgctttattttacgttttaagacttatagtaaaaattatacccaggctaaagtttcaaaaacttagatagagagatacacaataaaatataaaagtagtatttgaaaaaaatgtgattttacttctggttgcaaaattgccttttatatttttagataaatatttaccaacttattttggattataatcagattattgatatggttatcaaaattttccttcagtgaggttgttcatacacattcagctagattcttccaatggataataattcttagtcaaaaggtcaaatttattctagttttaatcaatgtcccattattgcaatccaaatgagcttaatattacccataaatattgtgtttataatttttatcttcattaggaataaaagataaaaattctaaatgtatggcttttgaaccaagtggtatggtgttggtttcttgtagaaatggtcaaaatactttgaggtatgctagctgttttagttttctggagtaatgtttagtatattattctaatagacctagaagcaatatccaaacaggccggagaagttaaagtgctcctgaaactgatctatttattcccgtggaggactcttggatctccttgttggttccttgttattggaaaatcatatcaaatatgaattcatattaaatattattctttcaataaacactgaaaaggaaattgtatttttcccatattgttgacaaatcaactgaaacaactttattttgcttaatgagtattggttccagccagatgggctcattgttatttcctcaaaagccagtagatggaaaactaatcaacattttaataagttgttttatgtacccaaaataagagtagaatgtgtgtgtgtttgtgtgtgtgtgtttgtgtgtgtgtgcgtgtgtgtgtgtgtgtgtgtgtttaagcaaatcagggagattatatgttggggggagacagaggctaaagcaatggcttttttaagttatttatctatgttccagtgtttgtggccagatgggcatctgtgctacaaagagaaggtaatattattggcaagatgaaatgatgtgagaggatttcaaattgtcctatgaacttatgagaactatcaatagtttctctagttttctatttaattgaagaaacatgactagagtcattagatgacctctacaaatcattaatgatgcagctggagaggaattctaagactcctattttcgagtggactgttttacatatgccactgccatcaaacaaagcaattcaataaagctagaggtaataccttgctgtgagcagatatttattagcacatgcctatcatactaaaattttcctaaaaccatctgcatagtattgtttgcaagaagtattccgaaatatgatggagatgaactattcagtttcagaatgactgcaataaaagctacaataaagggaactacttattgccatagaaacaagaatgtatgcacaacaataacatttgaaaccaacaagactgttcataatagcatatcataacctagaatcttttgcttacagtatgattttggtttgtgttattactgtaaagtacaccagtggcttatatttgcaggactagaactgtctcaagatgctatgatgctcaattgcatcatccagaatttagaatcagttaatctaattttagtgatggcaactgaatttccaggcacacatataaatttgacagtaaagtgtagttctgaaaaactatcctgatctctgtgtttgtatgtggcattgtgcattatttgataatactagagaacacattattttctcatccgaatttttcttataattaaaattaccattttaagtattggtaaatttttttacaaataagtaaagttttaattgcttattataaagttttatgatagacattatattcttgactttcttatacatagtaggttaaacataattaaaatttatcttgacagcctgagctcataattaagactatcaatgataatattttgtgagtcagtaatattgacacacaaatgccctcagtatctttttttttttaaattcaaccctgcttgtatttgctctaaaggatccttgtctgctatagtgtgtccttcctgtcaactgtggcttcactggggttagtactgcttctttgttttattcatttaattaccatttgtgaatatgtgactgtgttagaaatgtctgtagaacaaggacaaatgggttccgaataaatatctgagatttttctgataattaaaatgttgttgccttgatgaatgttttgtgaaatttatccagagacctcctttgtcagcttagaattccaaccaaattttatgtggtagtgaatgctagattgctaacttgttgataaatgtgttattattataatttgaacgtgtcagatatagtaccacacaaaggaaaaatctggcatgttgaaaaaaaaagagaatttcagggttcatctagcaaatcaaagaatattgaatcaatcaacaaataatcattacttagaggcaaagaaattgaactgtcacttcataccattagttagataatgattaacacagactcttaaaataaaaataaaagcttctgaaggccagttcacttctgttgtagatagcaaattttacctttcagttttatttagttctttgaaaacttataactaccagattgtaatagcaaccatacatagcagaaacataaatatttggtgaaaagacatccccgataggaatatccaacaaatataaagtactgtaatctaaactccaaattccaaaatgttaataaagccatcatggaaatggaagaaaggaagtaatctgaatacttgaaggcttttattttaaagttttacatgatgaaatcagaaaattgagtatttatatcaactataaagtgtcatctcagattaattgcctaaagttttaaagttaacagtttggatatttgcaataaagtcatctgcctaggagggatagtagtagtaagtaacagacaatctacattatctacatttcttcatgtaggtttctagtgggccttcttttatcttttattttctttgctaacatgacatctctaagtacattattttttgtgtttcatactttggattctacatggctgagtcataaacacaattctcaaggtcctaagtcatgttcgtacatgaaaaaaattttgttttggctgtaggatttttttttaattttaacataccagaaattttaccttcgagctctgaattttcaaaaagtggcagcaactttatttagaagtttcttctcatgcctcagttttgtcgcagcaagttgatagggctttagctacattatctcataagttctttaagattcatcgattcatattaaaaattggagaataagtgtgcatccattgatatttggcctttgaatttgttccacctgccaataaagtaatatttcttggcagcttgccatgaaaggtcagcacttcttggcatttttttcacctgatttttagatattcattcagaaatagttatttttctctgtggtcaaagctgtggtttatgaagatatacattcttttgcaactccatcttatagaattttgagtttattctgacaatttactttggtgcatataaaaagactgcttgatagtgccagtgtcagtttaagtttagatctttgtaggacatggcaaagaacataattttcattgaaaagctacataaacattataagacctagtacttgatggcacaatagggtgcccatagtcaatgataatttatacttttaaaaataactaaaattgtgtatttggactgtttgtaacacaaagcataaatgattgaggaaatggatatcccattctccatgatgtgattatttcacctcacatgcctgaatcaaaacatctcatgtactgcatttatacacctactgtgtatccacaaaaatgaaaaattaaaaaaaggaaagttagataaaaatgtatgaggaagcaaactttaaatgtcaggtctttctgataactagaagcatacaaatatgaaactacagtcttgtgcagtttgaattgctcactagtgggtatattcaagcagttctagttataagatgttttctaaaactgtgaataagagactggatgaccttgcctgaaagttctttctaatttaaatttccttgatttacagatataatgtaattatattgaccttggatttttgcttaagtaaggtttccataaagaattaggctcagaacatctgtttttctgggctaatgcatgggagtagtcttgatactttacatgatatattagagccattaatacaccagaattttaagaccaatttaagtagtgcaagcaagaataatagatctggggggaggatatctgtagtttgcaaaatttaatgaaaaatggaaatcaagtcttgaggaaagatgggaatcatggcagccctgaatctcagtagtagaatttgcagactatttgtagatgtctcagttttaaaacacttctattgctacatgtctgtgttcagtattcaaatttccatggaaaaccaattgatttaaattaagtcataacacttctgtggccaaagcagtgaattagaaaggaagttggtaggagaggagaaccaagcactatgacttccagacccaccagaaccaaggttcagtaagaatattggctgagagtgttatatcgaagatgggatgggctaggaattagaagtcgcccaaaggaccgggtaacagatgttacaccccagcgcacacaaccacacacacacacacacacacacacacacacacacacacacatacacacacactacacccttatacaaacccaaccaaacaaacaaactgggatgaaggtgagaaaggatgctgggcagataaaacagttagtaattttccaatctatttctgtctccccagtgatctctaagatccttgaagtcaaaattatgtcttgttcgctattaagtttccagcctctcccacatcctatggcacatagcattttgtgtagtacatattttgttaaaaaacaaatgaataaatgagtgaatgtacttaagtaaaacagtttagaagcttatggaaccccctttcatagatacgagggatgcaatttagcaagctgctgactctctgatcttccaaagctattaaaacacatgccagccactggatagtgatggagatgcaaacttcatctttttcttattccctctttccttttgtgtcctttcctttcttttattctcccactctccctcacttcatcttctcttttgttcctttcctgctttccttaatatgtactatttcgttacagatcataaagacaatataaattatttttacttattagcaaaatgtaattatacacaatgatatttaaatgatagttattctgtttgtattctcataatagttgaacacagcagatggactgtaaaatactgccaaaaagtcttggattctaaggtgtttttactgtttcccgtgtttctagggaaactgtaataatcaggtttttcatctgaatcctttaaagcttttatgaaatccagttcaaaagtagaactaatcatagtttataatgagctttgagagatttttcttgtaaattcaaagaaaaaaaaagaaccataagagaatttcaaatgctgttaatgaggctgaaatttttataaaaatcagaaaataactatcttaaaaacaaattgcatatatattattatgtatgttcactgtatccatatttgaataactatcaccagcaattcagggctctttgcattttatggtcacctaatctctaaagattcttctttatcaataacaggcgtatttaaagaatggtcactgtagcaagaaggtgttttgatgcacagtatttagaagaaattgtagcatcttcctttaaaacacattctaaaaattgcatcagcaaatatgcataaaagatcatattatagtttgtagtatttaaaatattatgcattagttcaaaacattaccgagttagcaatttttagacgctacttacaaatagctgttttggaagaacatgagccatttggagctttttggaagagttttattattatataactatgagcgtgtaagtgatgtcacagctcaagcagaaaattaactaaattttgaaaaattaatgtctccatatgaaatgaaaattcagtgatatcaagaatgctacaccaataattatgccctttttttgttttgaatgtcatcaaaggctatttaaagattgtaatgtgtttagatttcaagccgattgtgtcaaggagggtaagaaagtaccctagatgtactagaatgataccttctcttaatggataatgacatatatgttaagcaacacaaggaaaaaattttgttgtatagaaaattggattctttcctgtgtgtgcttttgtaatatatgcttaggaacacataagcttaatgccatttaaaaaacaagcaaacaaaaaaaggacaaacccagaaaatgatggatgtcctgcttacctggaatagatcaattttgtaagcacctggaagaacatctaatgcagacaaaaatcaatgtgactccatgaagaacacttcttgttggattaatcttattttcttctgtgccagaatgacaaacttagtagatccatcagaagtcaaagccccagtgtaacttcacttagtgaggcttttcttttattctaaaccatatcccagttaacaacctggaaaatgtaaacctttctacaaataagcaaaaggtgggcaatagttttggccaatggggacatttcaaataaaccctaccagtaccaaatatattcatacatgatctgaacaataccatcacaaaaacataaagaatatctaacatttgtttatgccttcccatatgctggatattattccatgatatttatatgtgttaacccacttaatcctatttgaagggtgacatatggtactgtataaaggcctggcctcccgagcctgtgtttatactccagctctgccatgtggctgtgtggccttaggcaagttattcagtctctctgtgactgggtgtattctcatgtaacatggggataatagttcttagcccttagagttaggaagattaaatgagatattatttttaaagtgcttaaacagtgaatggcccaaagccaatgctacatacattttgctaaataaatgaaaatataatccaaacaataaattgtcaattacagagaaatgcttagtaaggggatggccaaaatattgcttttagtgaagagctccaaacaatgcccagtgatagaaaatgattgagtaagcagagtataatatagcagaagaagtgctgtgatctcagtgggacgctggttgagcatatgtcaagaacacagggctgtaattacttaaaataaacagacactaggttttcttgatggaagagtgtcaaaacaatactaaccctgattctggtactttcatccctttttactacattgtaaccaatatagttttttctcctttttatatcccctccatccccttttccctttcttccattcaccttttatttttaataacaatttggagaaaaagatcacccagtggcaatatttttatcattgaaaactatgctggagaaaattaatagagcttgaactgatagatcatctgtataagatattgtgcattctaaacataagtttaaggcattcttgtcacatgtcatcatttaatacaaagctgaatgaaactccatgagaattatatttccctatcgaactaggccttctgtgtaccccgggggaatgaaaaccaggttttggtcctgccctggaagtgtgtgagtgactcaatttgttgcttctcgaagactttttaacattgttgtggatccagtatgaatcaccactgaagcgcttcacttcattgcctcttctctcaattattattttattttggctctgtacctgtagtataccttcttctttatgctatgtctaagtttttgttcaaattcgtctaacctttgagtgcctcctctatgctatgctctatgctcttacgcattttaaatcacttaatcttcacaatagccctttgatattgttattattctgctcactatgcagtttgggaaactgagatttagaaaagttaattaatttgttcaaggtcatccaataaggcagtggtagaggtgaaattaaaactctggtcttctcaatgttacaatctgccaatttcttctaaaccttttgttgagctgtgctcatgaaataaatatacagtagtgcttttaaatataaaggagttattctgctcttttgtaaaataataaagaccgccctaggatggatcgccacatatattttctatttctctaagtagtatgttcaaagctgaacatttgtttcttcatctttgccattctttccttcttttcccctgaagtttctcctctcttgaacatttaaggacacctcctcaaattgtttcttaattttagatgatgttcataattttacaatatttttctaggaatatttagttatgccactggggagatgcttatggagaatatgccttttttctgactgcttaagtagatgagtgcttctgttatctacctccgaggtgtatagaaagctgtagtgcaccatcttgttaatgttttctctcacaaaacaaagccagtgcttcttaaactttgtcttctaagattttctaaaagcctgtaggccgtgtacatatttccagtttgagtcatctaaagtagcttattttaagagaaaattttttgggagtctgttttctcttttaagttgtatgcatatttttcattttactgcataatacagagagtttttttgaaagataaaagtaaaatgttactcaaatcttcaaggaaatgtgcctagctagatttgtgtaaatctttatcttgcggtgtttcatagacacttggcttgattttacagaatatggaaatatactgtgaatttgttaagtgataatagtgcaaacatatatactattatttcatacaagcaactttttactaggcaaagattttaattttgactcaacttgaaagactagaactaaagtcatattacacaatccttaggtcacaaaccttaaagtctttctcatagcgattttctaatgatatatttgaatcttataattagctttccctttcataattagctgtattatacatctgatttttgatttcttactttaactcctttctcctatttccaagaggttagaattcttgcttatctgtgctgccatttagttctcaacattttttttttttctgagctgatccctctagcttttttcattctcctgcatccagtgccccattcatctcttccatgcagctgaatttagttaaatgtctaccttacttacttaaatgtattgcatgaacttttcatggttattcacttttagatttcgactcaaaagtgcctggattatttctgcctatcattctactctataggcaagagtgatgctgagctggaataacaataaacacaagaaaattcttttctggactaaacatctttattattaaagtgagaatataagatgttgcggttatctcaaaaatgatttcagaaaaggtgataaatatttctgtcttgggacagaatctactcattttaagcactgcttaataatcacccctaatgattaacctgatacctttatgttggccttttatttgagaattttctatatctccacccataatttgtctgaacttttaagtgttaaagatctcaaaaaggtattttatttcatatattgagggcattgtagcaaagcagttaagagcacagattagagacaaactgaaggtattaaatcccggtttcacacttatcacctaagagaccttgaacaaattaatctttctatgccctagtttcagaggataacaatagttcttaccacacaagagtgttgcatggattaaattagtaatgtctcttaaagaatatagaacaatgcctgacatattccaagtgctacctatgtattagttaatattgttctataatattatctccttaattaaattgataattccatagttgcagtgcctcttaaaagagccagttttatacactggcctgttttcctccaactctcatgtttttgtttcttttttttttttttttttttttttttttggagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtttttgtttctttagctcatgcctcattctgatataaactcctgccatctacattatagtatttcccctctttctcctacaacatgtgaaatcatgaaaacaaaggatgagcgtaatatttgaattatcctacgcaaattgcgaacctataatagtctgtgcattttttattagcagtttcttttttttggattttttttattatactttaagttttagggtacatatgcacaacgtgcaggtttgttacatatgtatacatgtgccatgttggtgtgctgcacccattaactcgtcatttaacattagatatatctcctaatgctatccttccccactccccctaccccacaacaggacccagtctgtgatgttccccttcctgtgtccatgtgttctcattgttcaatttccacctatgagtgagaacatgcggtgtttggatttttgtccttgcaaaaatttgctgagaatgatggtttaaagcttcatctatgtccctacaaaggacatgaactcatcatttttcatggctgcatagtattccatggtgtatatgtgccacattttcttaatccagtctatcattgttggacatttgggttggttccaagtctttgctcttgtgaatagtgccgcaataaacatacatgtgcatgtgtctttatagcagcatgatttataatcctttgggtatatacccagtaatgagatggctgggtcaaatggtatttccagttctagatccctgaggaattgccacactgactcccacaatggttgaactagtttacagtcccaccaacagtgtaaaagtgttcctgtttctccacatcctctccagcacctgttttttcctgacttttgaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttatcagatgagtagattgcaaaaattgtctcccattttgtaggttgcctgttcactctgatggtagtttcttttgctctgcagaagctccttagttgaattagatcccatttgtcaattttggcttttgttgccattgcttttggtgttttagacctgaagtccttgcccatgcctatgtcctgaatggtaatgcctaggttttcttctagagtttttatggttttaggtctaacgtttaagtctttaatccatcttgaattaatttttgtataaggtgtaaggaaggggtccagtttcagctttctacatatggctagccagttttcccagcaccatttattaaatagggaatcctttcctcgtttctcgtttttgtcaggtttgccaaagatcagatagttgtagatatgtggcattatttctgagggctgcagtttcttttatcatcattgtcatcatcatcactgtatcatgatcatgatcatcctctcatcatgtatagcatttgttgagtgcttaggatctgccaggaactagtcaaagcactttacatttattgaatcatttaataagtacaaaaatcgtatgaagtaggtagtattactatcctcagttataggtatggatatgtagaagtatattctctcctcatgcttttttcttacctctgtatggcctcagagaacacttatagtttgaacatctccttatagatagtccatgttcccttccttattttgatctcttggaagaggccagatggttattgagtgtatgatgctatgtttatcatttatatcatcaaagttttgagttcctgaccatctctcaggatatgaacaaaacttgaggattaatttaggggatattaaaagtgtccaattctcaaacacatggatcatcatgattctttttgtcaggcactgaattagaagaagaaacacatacagcatacattgtggcatgaaagagaatgggtttctgtgtgggatatcacataatgcctcattggatgatcaaataaaggagggttagtagtgatgaactgaaaaaaaaaaaaaagattgtatgtagtatttctctgtggtagatggggccagcctggtagggtgggaggagaaggcttggcatttcacggagacagatgcttgaatggattttgcaggtggttttatgttagttcatggtgggctcattggcagatctttctttggctcttttagttcaatcctggctcaagatgacattgtgtgtctctgctggcaatatatatacaatgaccttactcaccttcccaatatttttccagtatacattataatatatttttatttaattttatctgattttaatgcagcaatttttttcttttagtttaagtttttagagaaccactttatggataaaatttccttgatgctgtatgaatcagccatcaaaatgctagggtaagaagagaaacttaggtatctgctcttttttgacttaagttaaaacatcatatgcagtaccaaagtaataaaaactaacacttgtttgagtggtcgtggaatgtcagtgtcttgagtgctttacatagtttggtgccttttaattctcacaacaatccagtgaagtgagaactataattatccccattttgccaatgaagataagaagatatggagttgtcaaataacttttctgaagctactcacaaagtagccaagtaggatttgcacccaagcctctgtctccaggacccatgctcttaaccatcacaccacctccttttgtacagttttctctaggctggatgcttcattgcacaaatcattttctattagctatcaagcacaaactgagccaaaagctctattgctaagatgcacaaaattataacttgaaattgtttttctgcattctccattttttactagcaggagaataggagaccttaatttttatttcaattagtaacattgaaatacattaaacagaatctgtggtggcagctgtgtattctcactttgacttgaaaactacattcattgatatctttttagtctttggaaagaaatttattgtccattatagctgctactgctctgaacccttttgataattgtccatgcaagagcctgttctctttcctttgagaaaataacaatggcatactgtacttcacaggtgcaaaaatgaaatgatttgctccatcatttagtttgcttaatttacagctttttatgtttaattatgtctattgttcatagattggatattgaggatccaacaaagatgatatttgaaacagctttgtaatgtcattgagtaggtcctacactgcaggatacttaaatcttttctccaattgtgacagtttggatatcctcaggggttccgagctgtcttcaattatgccagctgtcttaacgtggaatgtaaaactactattacagtggggaattaaatattatttggcccaattttacctttctagtcaacagtgaatagcatgtgcctgcatatacactgaaagcagactgtagcgcgatgtgttaatgtgctgtggatacagttttcctttataagcatttatgattccaagagaatacccatctgccactaataagttgagtaaccttgagtatgcttctttatctctctgatttctacttcttcacctataaaatgaaagcattactaaataatttggaagccatttggcatagaatcatgtaagtcttattatttggagaattttattgttctcttctctgctccctgctctgatgacctaatggagcctcagcctcacctaaggctcacctcatgactacagtttctgcaaagattggcagctatagcaagatcactgtgatctcaaacttctccctactctgttatcctcagagatgcatgtttcctgagagcttttttagaaaccagtcagaatgaaatttgcaagaatatcagattttttctttttggaactggtgtgcagcaagatttcagctgactgtttaaggtatagttctcatttgggagagcttcgtatagcacttgcaaacagaaattttaggtgatatcctggttctaaaggatggggggtggtggtggtgacttaagcccataaatccttctaagttatatttgaatgccattctaggtatgcataatttattatactattcattttatcactatccacagacatgggagaactagaaattgagggtgggataaaattttagaggagtaagaagacactgcaggacatttatggtctaaaagcctaaatatttttctagttagtcattggacatggccatatccgggcctggatgaatctcaattattttcattgatttatttaataaacaagaatttgttgtggactcagcatgtgtcccgcactgttctggactcttggaacatagaagcgaacaaggaagacaaagcctctgcccctataagacttatactaccaaaaagagttcagcactgagacgtgagcttacttcctcccgagcattatctttatgcctatatatgttaattctctccttcacttcgctcgttttcattcttggaattctatcttgtcacaaaagccaaacagatagtgcaaagttttagtatactagacaaaacattattatgttatggcttcttgcttcctgatatggtggcaataattatgattggggaagattagtgtaaagcttctgcaccaagcatagtgctgacctaaggcagtaaggtaataagtaagttaataaatgaaaaatattggatgaacctgaatttggtctgtcttcaggcttggttgtggtgtagagtaattgggaatgggtggatgcatgtgtagtttttttcagtatcatgactagagggtaatagaagaatatctacttgtactttagaaaagaggagaccttggaagtgggagtaaattcaagatacagcacaaatcaactcagaaattcctatcatttggcagttgagaaaatttgagctgaaagttttcaaatgatttgtcagaattatacagaaattccctgggcagtttttggtgctggagggctgaagtggtggtatttagcttcctcaaatttctagttttaagaaggcagtcctaaactttaacccaaaggatctctgttccttgcttttttccagctggtagtatcttatgggactcttgtggcatattttcctgcttttgctttggctgggtttctttagggtaaatcccagggagcccctcctaaccctgcattatttctagagggaaaataataaaagggttagagatgataatcactggaaattctcaaaggataatcctccccattcaatatttggccttgctccttcatggcattatatatgggtgggaaatatcagtgtgtgcatttagctttgttggtctttgagatgcttcactgcacataatgtggcactaatcatgatgctctgcccagacagatgtgtctaacctgctatctgtgcacctgagaattggcaaggtgatgtactcagcattctattataagcttatttctctaggcacttcaaaagccactaatgaaaaagtctcttctgccacctgaggcatccttttactgtttcattggtttttaaagatgatcaataggaaatactctaaaaaacactctatgtctgaagttcaaactactagattttcataagtttaggcagctctgcacaattgtaatgctctttaacttccacttgtaatcatattgaaaatgtacatgaccatattacttatgcctcaaagttaccccagtgaatattttatcctcattcatttaacagtcaaggccagttctctgtcaaacattggaaggaaacataaaatgtctttaagaagctcacatttttagaaaggaggcagaaaaagaaaacaattgagtacaatgtcataaacactacaatagatttatatactgaatattataggtttaatatggcacggcaattaatgtgcatagtgattgtcctatttcattagaaagctattaaatattttcagcattctcaattaaaaggttagggtgtatcaatgtattatagaaagagttactttaaaatgtgttaattaaagggatatgtttgagttcctggaactgtcatatttcaaatattttcttttgtatacatttctgattcgtgaagaattattttgtttatactctgctataacctaacttaagaatttacattttctggtagctagtatatgttcagtagatatctaatgaatgattgaatagttctttatatgaaaaaaataccaccatcaaaagtttaattataaagttatagcataaatgatcacagggagtttaaacccaactgtaatttggttactagatagaggcattgacttaggtgatctatgcacagaactaataaggccaaggtcaaagtttccttctttgtatgagcaagttaaatttgtgttatgaaaggcagtggggcaaagatgtttgaggatttagctaaaacaatctgattctgcaagccataggtaaaattttagaaaattggaaagagtcagaatttaaaagttaaagtaataagaacaaaggctaaaacaggaaaaagcagaatgtacctttatccttatcaggagacgccttgaatcacagtactcactttgtacttgcctgcccataccgccttccagaggaactatctactgacagacgcagtcacctcagtggacgggtgttgtttgggccacttccctgtccatagttgactgctagatttgggtggaatcttgacccaagaacagctaacacatgcttctatatgtgacctggcaccagaatttgagctgtgtatatctatgtaaacgtagagagtgaaaccataagcagtaggaacagaattagcaaagttatggctgaaattacaaagaaggagaaatcacaagaaaaagagcccggttctgcaggaagaatagagacccaatgtgagaccaaccaggccctgagagacacaaagggacagagctgccaaagctcctgaagttcgtgttagtgtctgtgtccttcagattgtgaccaccccaacatgcattcagagacacaagatttttattattgttagaggtgactaaagtgactttttgttctttgcaacacacccaaagagccaattaaaatatttacaaatgctaatttgttgctgtgaggatactaggtggaattattttaaaagatatgtgtgttagagtgtcactaccaggatatataaagaaataaaaaaatcactcaaatcccttctcctaattgccctctgcctttatatctactcctggctaggttaggtgacctctgagaactgtccatcaaactctggatatatcactatcatggcaatcaatacagctttgaaattctctgttaatgggactttatgacactattctccactagattgtaggcttttaggggtaaggttgtggattatttattcttcctgttttagtacctatagtaccaccaaaatacctagttctgagtatgttcttgaagcaggcttgctgaaaaaaattgtacctgcgcataagaaggatgctttgttattaaataaactgatttaaatacttttttttttcccccaaaatcaaccataggtatatgtgaccactcaaaactgaatagataatatgtgatggagctgtggtataactcagtgatcttacagctacatagaaaagattttaaaatagtgaattgcaagtaaatttaatttccacataattcctgattaacttttatattgacagttgggaaacattagagaaaaacgttagtaaagttgaaggaaatatgctgttcagactccttttaccattaacaaagtagtttttaggtttccttctccaccagaggttgatatttggattttactgcttctgttatggtaaccccttttacttttatgctagtgcctcaaaagaaaagtcctgttagtcttcagagtaaatgagcttttcacacagtaactgggctatgcagaggtgtgctgtgccgggaagtatagctagtgccaagccacttctctgttgtaattatagggtcgttgggaaggttagtggaccttatccccttatggcaagcagcacacatgtgaagcctctcttgattttcagaaaacatctggctcagtagttcttggctcttcctttcaatgtcaagtttgacatatttgcatatgaaacatgtagatatttcagactaactcctatatccagaggaatagggacttcaatgatactcaggaaaaaggcacatatagaatttaaaaatttcatctaaaattttatgtaatagtctttctattgggtacattatttccctctaaaaagagaatttataaagcatatttacttaattcagaattataatgtttgtagaaattttaaatatgaattgtttcattaaatgttactttttcaattacattttcatgagtcaatctataaagtggaaaaacattatgcatttgatctttttgattgcattactcaatttttttatctgtttctattgaggtaaatgcaaataaaaacataggttatgagtggagaattttgacaaaaatgtcttatgatggggtaataaattcctaactaaccacaaggacactgtgtattaatataagaaagaaaaccaaaataaattacttagtaatgaaggagaaagaagacaataagaccaatgttatgaatggaacttagacactgaagttttcagtaatttattacaatctttaatgttaacattttgtcagtaggctctcttgaattactacatttttatttttagtgattatatatatcacagatgcgtctctaaatgcaaatatctttatatctccataaatgctcataaagacatgacattttgaaaattatccgaaggtatctttttctataaaattttaaaataatgaacatgtaatcttattgagttttcgtagggttattagcagatttcactaatattatacatatttttaagttgatttgtcaagaaatacaacaattgcactatgtaatatattggtaatttttttttttttttttttttttttttttttgagaccgagtctcgctctgtcgcccaggctggagtgcagtggcgcgatctcggctcactgcaagctccgccttccaggttcacgccattctcctgcctcagcctcccgagatatattggtaatttttaaaaaattgtttcacaaaatgaacagctgttcatttgtattttatttttttaaatgttcaattatagaagaaacatgccaaaggaaaattattgaactataagaagttattattgataatagctgccatttattaagagcttaccctatgctacatttcttattaatgttttacacacagcagattgttttatcctcataacaaacctgtgagattgctgctgttattcgcattgcacaaaagaggtaacaggtgtgggatatggtaagcacctggccaagatcacttagcttgtaaatagtgaattgagtattcaaacaggtcggtttaatgccaaacctcaggctcttaaccattctgctgtatttcagagacttcttaatggtgatatttttaaaaagataaataatttggtgaatttgtggtactttacaatggattagagtaagtaaaaatatttatgtcattgaagtttgaataaatatttctatacagtacctaaattatttttacttcacatcactgttttttaaagctgtttaaaaaaaaactctcttttaggtgtttcattctctatatatttaacccacatttttctacaaaaggtagttttaaatgcttagaaagttggctttggaatgaatatagtctaatatttgaaaataataaaaactgattataataaacatgttcataacatgcactgttaattattctttccagatttctactgactttaaattttttggcttttattgttagaccattcaagtaccacgaaaataacaggtgataaatttgactctcaatcagcgtaagatcctgaagttttgtttattgcaaagataaagtgaagatttatatggttttgttgttaagggcaatttttaaaaaatatctctgggttattaaactagttcatggtttatacagctctctattaactgagatgttttgttaactaaacacctattatgcacaaaagagatgtgaggcttattattttgctacttaaccacagaactttcaaatacttgtgttacagtttaataaagtggggttttcttttatttctagataatacaatcatgtagccttcttttcttgtccatcccatttttaaatatttgcttttctaactcctactcatgttcagcaacatacgcaccccttattcacagaagccgctctataagaatagaagtctcttagtttttcccatctatgacagaaaatttctactgagatactttctttctttttactaacttctcatctgagaaggaattgttcctgttttccttcagctacctgttcatttagcaccaatgccttctttatctctccctaacattacacaatcatgcctattatttcactgcttatgtatattctctcagcttataaatttgatcaagatttccctgttttaaaattccttcccttattcattggctgaactgcaggaaacttttggttttcttaaagttactctctcatacctcaactgcccttcggtagcaaattgtagacacagtgatcttcagtttttcttctctaattaccacccacttcttcctgagtcctttattatctggcttctacccacagcactaaagtgcaattgtttttctaaaggtcatttcttccttctaaatagccaaatctagcttcttaatctctgctctcattctactcaaccatgcagaaggctgtatcattactgtccacttgagctttccacattcaataaacattctttaggtgttgactaggtggtaggccttcgggtttagaagatggctaaggcccgcatatgccaacctggagtttccatttaaatggaggagacatacacaaaaccaactaccatacagggagctgagtgctctaacacaactgtgtgacaagtaagacaatgtggggcaaagagtggagaaactttcacagaggaagtggtatttgaaagaattagcggagagtgagaactctaggtatattaagttcccttgtactatacaagggaacacagaattgggaacaagtacagcgtgttttggaaatagtgtggttataacacctgggaatgtggtaggggtgggtgtatggtgggaatttggaaatagtttagggttgaattgtccagatttaaaacttctttccattggctttgttcctcccctttgcttcttttttttttttctatgttgactgctagttttcagacaattttcttcaaaaacatttcttctttcatgtgaagtcattctatgttctgtcccaagtgatattgtctactttgtgtcttcaaccattatattttgcacattgcagttgtctaaaatcttcctgtccctgatgacctctcttttgagtgccaaatgtgattttttttctttttctgtatgtcaattcacctcaaaccagatatggtaaaaataaaacagatcaccgtatatttatgactctttgctatttctgtattctttatctcgttcattatctccaccttccttttggttaccaagaggaggtattatactaatttttacttcctctgtctagatgacccctaacatccagtcagtcattctcttaaaatacttgctgtgtcttctgatccctattttcatactcatttagtttatgccatcacatttttgtcagaattagtatttaagtattttaatgattatttcactacctgcagcctcttctccagtttttttttataccagagttaaaatatagtttaagtaaatatagctaagtgtatttaataagttatagtctaagttattttttcaaaatcttccatattattcagttatctacagaataaaatccaactttgacacggtccaggactgaagctctctataatcttgtaacaacctatgtttccagtcctaaaattccccacataagtattcctactctatatgccttcaattcattgaatgattaattgcaacctctcatttaaattttaatgctccttaggttgaccataggtatttaagttatttggagattacaattatatgtgacagatttatttaactgtaagtatctaaaagacagggacttcactatatttacaatcagctactcccaagaaggttgggaacataatgcttttcaaatatttattatttaatacctccatccttaactgccttataattttaatagcaatgaaagagaaattccttctttgtaaattacacatatttgtgatttccttgagtctctttcccttttccaccaaataatcaatctgatttagctgtcacacacacccccacacatccatatgctttgaatacaactgctggttttacttacttcatagttcagtgtgaaaggctctgcagtagatagataaatacaaatacaagttgtggggtgatatgatgatagaagaaagtccacagtttttgagatcctatagcagagtcagctaaatcagattgataatttggtaatgggcaaagggtatatggacaaagcacaaattctagaagatttttccaacttgatgaagcttcatagcagaggaataggtcagctgattcgatgtgatattaaacaaatggttaggaattagtttttagagtagaactgtagtccttagaacccaatacccctctccagtattgccaacaataaacaatttgtggaagagcatcactcgcctccatcagacgagtgtcaagagactgtggtagattgttctaatattctaagtttattttcctttactagtctgcagtggattttatcttgaaaatattttttataattttataacatatgataagaattggattttataaattaaccaattaatgggcaattttgtagttacttttatttgtagtaaaaatatattttaggtttttagggttagtgatctgtgagtggctcttaagtatattcagtcttaaaaaagttaaagatcgtgtattattgtttccaatgccagtatagcattttcaccatcttgacaatatttattccagtcttgccatcttacaacttggtttggttatcatttggaagcacattgtagataattagaaactggacatttaaaaaaaattgataattaaacaacaatatatactgttaaaactgcacactgattattggcaaatatttcagaagacataatttaagtaattcagctgctctaaattctttaaggtaacttgatgccctttgtatcagtaaattttttttcctttcaaagcaaagaaaaaaaacaaaatcataaatggaaaaaatacctcatgaaatctcactatttgtcaacttcattttaaatcacattattgctaacagttccaaacttgccatttctattcatttctcatcatcactgtgctagcaaaaatcctaccacagttaatgttttgaagaatatagacttgggaaaataaatgtaaaaggctaatgtctatgctagagagaatgagagataaattaggcttggttatacatgcctttattggttattcattgaggacctcagctatgggccaggcactggcctaagtaatgagacaaaagatagcaaacatagaccccagcagcagattttttcatatgaagtttcaatatatttagtgtattcttttgttaaagaatataaaaaaagtctcttaggaagctatgtgtttgatgtttgagataacttgtccaaagatgaaggtcaaggaagttcatttaagaaaggtgacattcagctggtcttagagcatgtatagagtttgtaatgggcttaaaaggattccagtccaagaaaaatcatgaggaaatttacagaattgggagctaaaaaagtagatctcatggaggcagagaatgtaatagtggttaccaaagactgggaggggaagagagaagggggggatgaaaagaagttggttaagggatataaaaatacaattagatagaaggaataagttccagtatttgattgtatagtagggaagttataattaacaataatttattatagatttcaaaatagctagaaaagaagaattatgagatgatggatatcccaattactatgatttggtcattacacattgtgtatgcatatcaaaatattacatgcactcccagaatgtgggcaactattatatatcaataaaaatacagaaaaaaaagaggatacactggaggaaaaatctgctgaacttgaggactagaagggaaatcattaggcatgcaagagggagtaattggacttgggtgtttggaatttgggaaggggttatagaaatatttcacaatataaggaattcaagacaaaaatattttggacaaagattagagtttaatttttgggtcatgtagtttccagcatgcctggggcaccgagtgaaggtgtccagtgggtagatagatattaaaaatcagagaacattagatttatctgagctagaaaaaatatgtgggggtcatccttataaaaggatggtttaaattagttgtagtatagatagtggtcaagaaacattaccttgaattagtggttattatccccactaacctgacagaactgcagaaaacaatggcaaagctttatgcctgtccttattttaattttggctcagtgcatgtctgtgaaaaggggggaaatctattgtattctctcatgccccttccaagttagctctcagaaatagtcagaaaataaaataatttagatctgctatcattccctaaaaaaaaaactttaggggagcttttatcctgatttttacttgactcatggtggcttattctccaggatgacagatgacagttctgtcataatggacacggcatcacacagtttgagtttttgtttgtttgttttctgagacggagtctcactctgttgcccaagctggaatgcagtggcctgatcttagctcactgcaacctctgcctcctgaattcaagtgattctcctgcttgagcctcctgagtagctgggattacaggcatgcaccaccaggcctggctaatttttgtagttttttttagtagatatggggtttcttcatgttggccaggctggtcttgaatttctgatctcaagtgatccgcctgcctcggcctcccaaagtgctggcattacaggtgtgagccaccgtgcccggccagtttgagattttagcagctgtttgggtgcaagtttcttctctgagcccataattcccattatatctatccttgaatgttcttctgatgattaaatgatgtaatatatgtaaaacatcaagttgagtgccatatactcaacaatgatatttcccatctctttttcaagacaacacttttagtagcactttaataatttacttttcacatacttgaattagaatatctatctgtggtctctgtaattttcattttggttctgtgtaatgatactttttaaacaaaactagtagatatgaggaaaggggcagtgaagctttataagctgctatgcttgcaatggggctgtaccttctctcactaagacatcaaattcactaaaaaatatgtttgatagggcagctgctcctaccagctttttgagaattccatcagttttcatccttgattattttgcctgctcctgatgaaataatattccttttttcacctgctaatatgcgacacatgtttttaagcacaatgaactagacaagtgaaaactgaggcatgaaggataagacagtgaaccatcaggcagggcttctttctttaattgtgctttttggttctattaagtatcttataatgataaattattgagaattgtaaaagatcaaaacacatgttctgagagcagaaaatatatattttttcactgaaaacatagttttaatcataaatgaaaggaagcaaatatttccaaaaaacatcttaataattcgattcagatttgttgaaacattgtgttgtcctatattgtaccatgtagagcattcattttaataatttaacttcagctggatgctttccaatgatgtacttaggtacttacataattagaaaaatcagtgatttttgcaaatgcttttacccctttatcccacacaatttttccatttaaaaatatttttaaaggctgaatatctgaattttaagtgagatttgataaattataaatgtcacaggaaaaatataaggcatcatactttacatttttgtgtaaaacattttaaaattggaatttggaataataggactatctaatatttgtatgatgttttaaagtgtaaagtaccttttcatctacattatctaaacactcttcctgtaaaccctatgaagttgacttggagagccattatccttgtctttctgattttagcacattttagtcttccattattttcttttatgggaaaaacaaaaaaaaataagctttaatactttaaaaaatgcaacaaacaatacaaaaatttaatagaagagatgtaatattcaatatttctattttaccatactatttatgaatattacagtaaactacttcagtatttgcttaatatgtgcatcttggatccacccgccaaggctgaatacaaaatacaacacacctatttttttacattcaaattatcattaggctaattgctagaagtcatgtctcctcaagtcacgtttaagctggttttaagaggtttctagtgttctgcttcatgtgtgttaaaacaagcatttacatttctttcttattttgttacaatactgcgtccactaacaatgacccccagaagaacgctattctcttgtgcacagctgtggcatggggatggaatgagtgaggctctctctttgaacacttctgtaaaaacttgggacactttcctacttcttcacagcaaaattaagatcaggtcacagacagaagtgagactgtatcaaagcctttttgaaaatataagaaagaataactgagtgtaacatcaactgaaatggcaaaggttcatctcaagagccagatgcccaacctgaattcaagttgctcactgtgcctgtatgtctagcaaagacaccaggcaggagtcggctttctccctaatgtaagtatttcaaatgtctacttgccttggagagttgaccaaactgtcatctcattttctaccagacactgggaagaagttaaggtgcctccttgcgctatataaaccccactgcacttctccaccagattaacttcttcatcatattattcctttcaggggaatttcctacctcacagctccttcagcatatgatctggtaccatggatccaatgtgatcctcttggtgcaaagtaacatttcccaaactcttgatttgttcagattaaaggaacatgtgtatgggacaatagcactccgatgtatgttacactctgccaatacaacactgttcattccattcattctgtagggtgagggaatggagcctcatgattatactctctctccctcctgcaatagtctcatccatattccccaaaatgttacaaaaaaatatgtctcaggaatgaggctacttaaatctagacttttaagatttaggaggaatatatttaacataatgtacaggggctggattgtcctgaaagatgtgccaattacattaccaaacagaacacattccatttcggtctgaaacatctgcacttgatttacctcatggtattcagaccttccccaaaagaagtatatatagagctctaagagaaaaataggcccttctaaagtggttcctcgaacaacaagggattagttggttaccagtataattctgccaatctttatcctagaagcagaaaatattgatgactcttaaaacacacttttcccaacctttgtaaagaaagtgtttggttcagtctttaccagtcagcacaatatatttatttttaaattctctaatttttctactttgaagagtttctaaatgaatataattctaaagataaagtgcatttttatatgttctttgaattattcagttcacctgagtgtaaaatatgacaatggtgatgtaaatgtattcactccacttccttttttagtgtgcaaattatttaacaaagaagattgcattgaatgtataaacagtgaggaaagaaactactaaaagaaatttcatgtcaataaataaatatttactactttattttagggattagatttaatcaaattctacctgtgtcagaaatccatatgcagttgacccttgaacaatgcaggggataggggtgctgacccccacacagttgaaaattcatgtataacttttgactcctctaaaatgtaactactatttacctattgttgaccagaagacttaacaataacatgaacagtagattaacacatattttgtgtattatatgttaccaatataattctgccaatctttatctttatatacctattttatatatatatatatatgtgtatatatatatatatatatatataagcaaactagagaaaagaaactgttattaaaattataagaaagagaaaatatatttactatttaagtagatagtggatcattgtaaaggttctcatccttgtcatcttcatactgagtaagctgaaaaggaggaggaagaggaggggttggtcttgctgtctcaggggtgacagaggtgaaagaaagtctacatgtaagaggatctgtgcaggtgcaaacccatgttgttcaagagccaactgtacaagtgttctgtcttcttaaatgaagccaattttggtaagtgtgatcataatacatatgaaaacatgtagtgtatattttgaaatcttaagtttgatctgttggcagaatgtgactagattaaacttcaaatgtattgaagaaaatactttctgagggaatactatgtggaaagatatcactacagctacttacttgtgttcacataaaaacatctagctgtatgcagactttctcctttaaaaaattttctcctttaacaaatttttaaatttctaaatatttaaaaaagagtcttgccttaaaatttttagtataacaattttgaatttcaagaaattagaatctgaattgttaataaaagtcaaactaagaaacaacaactttactaatgtatctttccatagtatattcatccagtctaaaaatgaaaaaatttcaaatatcattagtataaccaaaaggtcttatgttactttatcagttattagccatttcaaaatcaatcagtgaattaagtaaaacaagaaaatttttttattctctatataaatttttatataatagacatatgtatgcctattatatataatataaatgtctattatatatgatagactttatataataggcatatacatataatagacattttatgatagacatatatacatatattcagatatgtatacatatatacatgtctattaaatacatacattttctataatagacaaatataaatgtaatagacatttatatatgtatatatgactatcatataaaatatatatctattaaataaaaatttctttgggagacattttaaaaattacagagcgaggaagctagaaagctctgtaatttttagtgtatcatcaatataaaggtcagaaactgttttacctacaaacatatatttcattgtattttctgagtgccctgtccactgtagtaggcaccttaaatattttttgatggcattcatgatgggaaatgttatatttattttgcgattttcttatagtttgattcttgttcattcacattctttctatcttatttcaagattccatgatctctcttgtcatattgtagtactttctaaatcattttatatctcaaaaagtcttttgtttccaatgcatcttacaagataaatgccatattaacttcacaaatgcaaatctgtcatgtcactgacttctttaaagactccaagcattcttcattttttttctaaatttacatcaaatctcaaaactgatattatcttttattgcttaggtgttacctgtttttcctctatagcacatattttctttatcaacttcacattctgggcaaatggaataacatcctgtttcataaacttactctcaagaatcattctaagtccagctataatgctgccagcttcagaaattctttagaaacagagttggtgtttgagttgcctacctgtttggaatctaaaccttaatcaataaagttacacttctgtttcttagagaggtaaccagggttattttgtggaagagcatggtaggttcatcccatatgtcaacttattgaatactaccatcctgaatccattattaactcatcttctgaatttgcttatacaagtatcattttgttctttactgtctaaaataattatttaccatcataagataatttttataaaacaaataggagaaaactaattttaccttttaaaataatatgccacttgtagatgtagaatacaaaggcaaatatttagatgtaaagcataatttaatattcttgtttctaaccagtatgaactttattgatcttattaactttgtaaaaataatcttgggagaattgtatagaatatatgttgtttatcttagtaaatgacaaaaagaagtacttttgtgtttaagtagcttttttgtcaaattaataatactaaacataagtgttaatcttttcttttccaaactatttcacatcattttttcatttgattttctcagctctctgtactgtactataaggcatgtttctgctcaacattctacattgagcataaacaaggactaatgccaaggtaacctaaatcctttgtgcttctttgggcacttgacatgctcacaaccatgggtaccatttctattaaatgcaattatctaattggaaaagttgcaaataatctgatgagtgagaaatgcagattcaatcaagtctcagcttactaccactgattataatataaatcctggtttgagcctaacccttttacatgactatcccttcttctgtttatctactttactaaacaatgtcctctagcatatagactgtacttgtatcctaaagaaatcttagaattgcatctggttataagaggatgaataataaatgtaatttgaagatgtaaatgatgctactaaggattttaaactcttggtaatcttactgtgcaatgcaaatgtcaaccataaaatttatttttatagccttgtgaccatttctaactatcttaaaagttattaaaatttgccttcaacacatttttatttaggtgattttttggttatttaaaaattattttaaaactttttggttttttaaaaattctgataacgagtctatccagtcacatatgaaagtctacagaaaatagtgcagcatgcaactacattattctacagcaatggaagctgtcatataactatgttccttttcacatgaaaataaacttgcctggagtcctgtgtttcaacagaccattacagagctggagtaggaggcaattacaaagacaaggaccctccatgaaaaagtcttgctttgagagccataatattcacgtttgtccctagctgtgagtataaaccaatggaggagagacttctgaaattgcaaagacacatacattctgtacaaaatcatagctttgttattctgagtcctttgtaacaaatataggttacatgaactttagcctcccagatagttttaattttaattcaaaaaaaccctactttttagtattgaaaagtataaacgataaacatttaatcacataaattatataagggaaaaataaaattaagcaaaaatgctaacagtctcaaaaggtatttttaaaattataatattataaataaagcttttaaaagtaattaagtagatgttaaactttatgatccaaacggaactacattcccaatagaagttcttttatggctgataccttgaaatctacacaggaagtaaataatctgcttagtaaatttataaatataaatattataaagctgagtggcttaactttattgctgaattattccaaatatatttagtgtgtttgtaaacacatgtatatctagtgatatacatgtacgaggatctaatttttatacatttttactatacctcatatatgttacccaaataatagtccagggaattctttatgtttatgttgatatttctatccaaagaataaccaaatattaatttaaacaaaaacgctaattgcttatgaaaaatagatattaattagagtacatctttagcctcctaaatcctttcggaaggaatgattgtaataaggtgagtaaattcctagataactaaaggttaacctcctctgcctggatatatttattttaaatactattgctggaaatctttttgaattactttctttcttgccttcttaaataaatagtacattgagtttaacacaaacatttcttattgaatcagagtaatctttgaactttgtttattgtgaagcactaaagcttcagctacttgtagtaatatagatagaatggaaaatgcaatcaaatggctatgatgcttgaaacatgcaaaaactgcttaagactgtcttcctcagtagttgatattagtgcagtgggtgagagagcagcctttgaaaacatataggctcaagtttgaatctcagtcctcccacttccatgatctctatacagtttgggaaagatcattttaccgctacaaaatttacttttctatctggtaaacttggggtaatattaatcttgtagggtaagtataaggaatgaatatgataatctatgtaaatcacttgagccttctggcatttaataaatgctcaagaaatggtgatgatattctacaagcagcagatagtgagagcagtgtgaaaactagagaaggacaaatcaggataaataaagatagagtttcattctcctttgtcactcctcctatctttcttcctttcttttctgcccagcctcccccttctccccctgccagctccctctctgaagggacaatatggtctccagtgagggatgtcccaaatgcaggacacatctttgagtaccttattgaaaaattaaatggcagttcacctaagaagttcttccatgtacctaaacttggaggatcatcgatagaaccactaatttgagttactcttccttgctggacatgatttgccctgacttgaatgccaacactttagcagatatttgcacatgtctgatcaaggtcaaacctttccctgtggtctcagaagagtgaacttggctgacctccagggccttggatgggagtcttgactttattgacagttgagtaactttctcaggccaatggagggaagacttgtttggaaggatgattaatccttattaacttttccgtgaaaatgacatgaaaaggtaaattaaatgccaagtctactgtggtctgttgtgaagggagcttttgtttaatcttgttttcttcttctagcattatttaatttaattgaaaggatagttcttgtgatttttctgtagagtttgattaaatattctaggctgctatgtgcagtattttgtgtatgtgagatttagatattttggagtatcttagaaaactgtcatcttagaattaggttgctatttaaaaataaacagtttgcaaaaatgaaagcaatatcctttaacttgcatgtttagtcacagtgatcagtattgatatgtttgttaaaaacagttggtttacacgtgccatgatggtttgctgcacccatcaccccaacatctacattaggtatatctcctactgctatcacagaatataaagtactataataataataaaaataataaaaactgattagtaacataaaaaaagattggtcattttcttagtgccatgttttcaattcacatttattttatcttttcactgatgagtttgcattaattttgcaaaaattttgccatgtgtttttaattcatatttagtttatcttttcactgatgagtttgcattaattttgcaaagggaacaactaaattgattctgtgcaagaaaggtattttatttccctttacttctccaaaatatctagtgattctggcctggaaatgctttaacccaaattttatagcttaataaattaaaagagcatatatgatgatgatgtttttaaaattgagtataaatactttctgcagataatttgtagaactgtgcctacttgaagatggcctatatttcctaaattcaggaaatcagtagggaactaccaaaatcaattgtaaatggtattaaaagggaataattaataatataaaagttaaattatctctgatagaaaataaactgtcatggacatctatacataaccatgcagaacatatctgtatataacaaaatctcatgcaataatatgataactgtaaatataaatgcttacaaaacagaaaaaaggtggaagattacacaaagtatttgaaagtctatcatcttcaaaccagtgttcttattgtctgctgccagagtatatactgttacaggccaatctttatttttgtgattctcaacactgttgatcttgattactattctgtatcttttttaatgattttttgttactttctagctttgtcatttaaaaaaagttgcttttttattttaataaaaaattcttacacagatattagcagccacagaggtacttctttttagcaaacaaattatcacaatatttggtagcaaattctttctaatgcctttttatgttctccttggtgcttaacgggtacttttatttttcttatttttaactctgaaacagtatatttctaccacttcctcataccaccgctctttctcccatcataattatttctgagtttgcaatcattgtgataacactagtttttgttgttaatgttttactgtaagtgtgcgtaatacaatatgctataagcattttaaatacttgtgctaaactgaagccaaattcaatttatgattaaaaagaggggaacaaataaaagtagaataggaaatgctttgccatcacaaggccaaggttagttgttttgatttcttgcttaaagataaaaatgtattgtagatgtgtgttccttttagagtgactcaagcataaggggaagtagagactttctatgctgtagttcaaaacgtaccctgagttattgtgtttctcaaggcatctgtactattttctaccatagaaattattttcttgtacttggcctcagtttctttttttttttttttttttagaatcactttaaggtgttttgttgttgttgttattgttgtttattatttatttatttatttatttatttatttatttatttattttctgagacagagtctgtctccgtcatccaggcccaggctgcactgcagtgacacgaccttggctccctgcaacctctgcctcccaggttcaagaggttcttgcctcagcctcctgagtagctgggattacaggtgcctgccaccattcccggcttatttttgtatttttactagagatgggtttcactgtgttggccaggccggtctcaaactcctgacctcaagtgatccaccttcctcggcctcccaaagtgctggaattacaggggtgagccaccacacccagacactttaagtttgataattcacgtgtggtgatggttgtgatgtctggtggtgcttagtgaaggtgttgcctactacaagtttttggcataaaggaagacctcaaactttgctcgaatcatcttttattgtctatgtttgtcttttgtagtttactcagacatgcttggggttggttagactactggtcatagattgctcaggagcagatttcaccttgagcaaccaggaggcagcatgttgatggggacaaaagcagtctgaagaaacaaagctaattgttgaaagaagccacaggccttgagatacacattcctctttaattattttgcagagaatcagctctaatactcacgttgtttcataatccagttcttttccttctggaggatttctatcattttcactcatctgtaaacaaattccaaaattagttttattcatttctaaatctctggggctcagcaaagtgttggatacattgtgacaaaatatttgtgatagatctatttctgctgaatctgactccttcattttatatacttatttttttccagggtgttcatttttacagaccacttgaattctttcattggacaccacaggggctcatgtaacctgtaaatacaaataagccttcagtatttaaccaatataaattgagaattccctaattctctacaacaaaagtgacaacaaaagtgggggtgtttttcttcttttatggtagaatttaaaagcttgttctagagaaattttcctttaatttataaaaatcttttgtcagtaatattaaactctaactagacttgatgttttttctccctaagaaatcatgtaacttgcacgcagttaccatcatgtcactctttttacttctctttaatgcactcaaaattttaatttatactgagaatagaattttaggtcttgattgtattttctattgagattatatataaaaatatttcatgatacataaaatggaaggaaatgttttgaaggataaattataggtgtttatatatactgtttattaaaaatacaaggataatacaaagcaactgaaaattttaaaacagcaaatgtgagcttgaattttagttgaggtaactgttgtataaataagctgttaaagtgtatatatatacactgtatatatttatatatttaatatattatgaatatatgataaataaaaatatataattatatatacttatatataaatatataaagtgtatatatacactttagcagcttatttatacaacagttatgtatgtatatatatttctaaagagcactaatgtaagattttaacccttttttttaagaaggaaaaacaaacatgtaaatgaagagttctatacccaatttttagacaataaaatataccatggcaaaaaaattgacgaattgtaatgcccagtttgcactttaagttattaataattctcatctctgtgttttcggactacctactaccagcatgtacagggcttgcttttgtaaagacaaatacaaagcagaatgctactctaagtattataaaacctgtttactcggatattttaatagaaaagaatgtgaatctagaatggcaaatttaaggctaaatttaagatttaagtctaaggtgtaaaataacagatattatgtggtaacctatttttaataaattcaactattaagttagctatcattaggctttcagatatataatttagaataatatatttaatacaaaatttttatgtttattgaaaatgctgttcttatatgctggggaaattctattgaaataaatacctctaacaatattatcaagagttacttctttcaaatgcaaatatgttgcacctactaaaagtgtttggcataatattgtcatatgatttaatatttatttaatattgtcatatgatttattcatattttagaataattttattgcctcttacctgtaatatatgccactttattttcattattttcaaagataagggataggtacaacgaaattctccccaactctcaaaaaattaagttcctctatgatagatggtaacattgtactaagatagtagtaagtaatattacattaattcagtgcatacaatttatagatataatactattcaaataaattacaaatgtaatagttttctaatttttttgtagcagaccaagtttttaattaacatgggcagaaaaattagacattactttctgaaaaaaaggtttatttaaataaaatctaataagtatatgtaggaaatagcataaagtctgtaacatttatattgtctccattcagcagtttttgagacatttctgtggagtaaccattctacattagtaaatataactgttttgttgttaatctgaaactaaacatatctgaatatggctttcttgcatattgggtggttttgttgaatcatgatttcacctagaaaatatagatagtgttctgttgcttaattctattagttgaatatatttctgggactctctcaaagacatggtaattttgtttttatttttatgaaaaccattaagccttagctttataatctttacaccgtaaaccataagattaatttctgagctttgcggctggtctaactttgcattaattgtcttaaattaacatctgcagcctggtctgcatgttctgtcatcattatttctgtttccattcatgcccacacctggcatttaaaggttccttttttgtgtaacctatgtaagaattgatttttccacctcatcaccccatgttctttcaatttagagatttttctggaaagcctagttagtaaataattgtcagacagctaaacaaccaagatgtttgagtctagaatttgtgtatttaatagggcatatgatataataaacatgtttgaaattatattatcatattatgatatatgatattatgataggatattatatcacattaaacatgtatattggggtgtttcttttagtatatcaaatttccacacattttctacaggatgctcagctaccactgataaggaaggaaaaacatgtctctaagcactttcaatatcagcaggtattggcagtgggtacaaggaagtcactatttccaagggacatttcaaaccaggactcttgctctaaatttttgagcctgaaagaattttggaaatctgcatgaaagtctcagtcaatgctattatcatggtggcatttatgatgtttatgaggtgataattgttaagacatcaaaacctaatattcctctgggatgaatacaagttataaaattaataaaatcaatattcttttttttccttttgcccagaggaaattactatttatattatgtaagtatgatccaccctggcatttgtatgcaggaaactgatgtgtttaccaagatttttaagaaaatatctaaggtgatacacatggcaaatatctgtcacattatgcatagaaatgaatttttatattggttttcaaatgctaagttaagctcttttgttatttttctaccagaatcaaacatatttaggtatctatttaagaaaaatggcatatatgtattacttttctgtgtaaatgaggagaattgctgacaaacataaggcacctgaacataaaaaatttttgctgcctgcttgctgattttctaaatgtacacttttatctaagtgttttgttgtggcaagtactagagagacacaaacaagatccatttcaggaaaaaaaaaatgtccttgtagtacatagcggaggccacattgaataaacatataatgaacacatcatgtttttatatctcgtaatctaatcagattgtctttagaagcaaatgataaggatttcaaccttgcttaagaaaggtctttatagtggtgcttagggaataaatgtttgatttcttaaagatgtcattagatatcaagtaatagactaatgattagattttgtttgctttctttgatatctgggttacagttagttgcatatggatacaaaaaaaaaacaacaacatcaggctaaatgtaactttgcatctgacatagggagttcttaaagaaaactaattacttgaccctttttgcactataaggaattttaattaaagtgactttttttatttgttaggtcagcaatatgtcataaaaagctatatgaatggtagtaaataacataataacagcattcattgaatgcttttaaatgacacaatatttttatgagaacattctctaaatcatgaaaattaattaaaaaaatatttagagtaatttttgtattctcagaaaccatattttttcttctaaataagaaaataatctgtcaacctcaaattagaacacctataattctatgagccttcaatccaaatattaaagttttaatataaagtcaagtattttacaaaaatagtcaataaaacaagagtgttggctatttagagtacacatagtggatctgtttatcttaaacagtgttatgaatcaacataggtcaacagaatgaaccagaagaatgcatgactttaaaagtttattttccttgagaagatgataaagtacttactaaaatattacccaggtctctccttacattgcgtgaatcttaggaaaatataagttaacacaatgtatattcatttcctttattcaagcagccttgagagagaagggaccaaaggaaagatgccattaatctaatgaatgaagagctcctgtgttcctggggaatggggaatggatgggaacaacgtagaaggtgaggtgggaatgcctacgaaaggttgaagtctagatcacaaacttggctcccagcatgcactggcagctcatccatgcagtgtgatggatgacactccaaacccgattcttcacctcacgttctcccttagaaaggaatgagacttgcgtcttgatccaggaaagaacatctgtaccctagaagccattggctatatttattttcaacagtgcatttcattacagccagggatgcacaggtttatttattcataacactaaatgctctccattccctcttttcctggctaatataaaagtgtgcccaatttagaagaaatgaacaagagagtactgaaatatgccctctgtgtattactgaagggatcccaggaacacttcagcagtaccaggttaaatctgaactctgcctatgtattttctataatgttgaaaattggaagaacaaaatagtcttggcattgaactgacatttcattttgtttgagtctcagttccactttataaaagagcaccacaagccggaaagcaaccagcttagattggtatgtgtgctggtgccaagagagctaatcagagtctagcatatggggcatttgaacaaggaaatggatgttaactatctggttgtgcatttggactgcttcagaatcatttgggttttgcttggtaatctgagaggtagccaggaggggatagaacagctgtggccactctacctgtaagtgccttaattacaccctttggccttcccaccttccccacctgaatattcctctttggcttcatggggtgcttttctaaactgcctaagaactatttgatgaaggctcatttctagattcaggaataaaattgttgttgatgtcctacattcaaattcagtgaacatttattgaatatctactatacatccagcaacatataaattccatccattgagatgcaaaataaaacagttttcaaaagcaattctgaagcctgatcatactggtttgaatcacaactcctaccattttctgaggtgtgactgcaggcatttaacttctttagatgtgtttcattttcctaatctgtaaaatgtaacagaagttagcaaaatattgttaaataaataaagtaaatgtaggttatatgtgtgtacttagaccaacactaggcacattaaaagcacatagtaaatgcctgatgtcacacacacacacacactcccttgatcagtataatatctcttgttatacatatagtgttattctccttttgctgataagagaactgagagtcaaagaaatgaagtatatattcccatggtcatgaacttagaaagcagcagttaagattcaaaatgaaggttgtatatttcatgattcattttcttttcataataccataataactttaaggtatttccatctctagtcaggaagattgcttccaaaatgctctgcagacagtttcatcatgctctcttttcttttctctttgtctctttatctttctttatcttttatttcttttttttctttctttctttcgctttctctcttttttctttttctttctctttctttctttttctttttcttctctgcaatggctgtcctcacttagtctatctttctaacagtttaaaagatacatttgggccgggcatggtggatcatgcctgtaatcccagcactttgggaggccaaggcgggtggatcacaaggtcaagagatcaaggccatccttgccaacatggcgaaaccccatctctactaaaaatacaaaaattagttgggtgtggtggtgtgcacctgttgtcccagctactcaggaggctgaggcaggagaatcacttgaacccaggaggcggaggttgcagtgagccgagatcatgccactgaactccaacctggcaacagagcgagactgtgtcttaaaaaaaaaaaaaaaaaaagaaatgcatttgataccctttcttctggaaacattgtcttctctgggcttctacagtcccattcttttttaaattcctttccaactttatgactacttcttctcatcctcctttgggagtcttccttaatttatcactacattttggaaagccccaaggcttgaagtccttggacttcttcacatcttattctacaactttttttctcaaatgattgtatctaattctcgtaactttaaatactgccacaatctgatgacttcctaattagtatctcatctctggctaatgccctataatatagattcttacagccaactttctctatgacatctcaaactgaactctttattttattcccagccaacctggagattttgtttggctggttggttcttttgttggttggtttttttggaatcttccctgatttaacaaatggctacccaacctcccaactgtacaggccagaaacatttgaagtcatttttaaattgtctctttcccctataccccatgtgtgatctgttagtcaaatctgtcagctctaccttacagttatgtccagaatctgaccatttttcaccacctcttccactaccttcctactctaagccactattatttcacatctccattattacaggagcctcccattagttcacctgcatctatccattgtttcttttgaacacaatattcaaagtgattcttttaaagtgtgaatggcactatagcattcttctggaaaaagtcaaaatcccaacaagcacctctaaggccctaactaacccccacttcccacccgaacctctctgccctaagttcctaccatctttctcttcctttctcagcctctgtgacctccttgccctttcttggaaatgccaggcatgctcctgcctctgggagtttacactttgctgttccttttaccaggaatgcacttccttcagttatctgcatagttccctctcaattcccctcatctatgcctattctccaatgctaccttctcagtgatgatttgcatgatcattctattaaaattactgcccaactcctagcactcctaatttttcttctgtgctttatttttctccataacaataattaccctctctcatcctctatattttacttatttttcccctgatagaatgtaagtttcaagagagtagggatttttgccttttttcagtcactactgtatctctagactctacaatagtgcccagcacacattaggcatgtgttacgtttctccagagggacagaattaataggagatatatatacatatatatatatatacacacacacacatatatatacgcatatatatacattcacacacactcacacacatatatgtgtatatatacacatatatctacacgtgtatacatgtatacacacgtgtgtgtgtgtgtgtatatacatatgtatatgtatatataattaaggagtattgactcacaggatcacaagttgaggtcccacaataggccgtttgcaagctgaggagcaaggaatccagtccaagtcccaaagctgaagaacttggtgtccagtgtttgaggacaggaaacatccagcatgggagaaagatgtagtctgggagactaagtcagtctagtctttttattgcatccttcaatccaattaatattacccaccacagggcactcaatgaatgtttgttgaatggttgaattaatatattctgtgagaatttactgagcattaactatacaacactagtgtaagtgctgcttaagatagagatgaaataagaatactccatgccttccagaaaattaaaatctggtttaggagatgaaacacacaaatatctgtctgtagtataagatagaatattaatggcataaactcttagaagtaaaatactaaataaaatgttagaagtaaaatactaaggggaaataagattggtgtctttgagaaactgacacctaaaaatgggccctgaatgtgtggttggatttcagacaaaaaagatggtgacatggcttggttctgcctcacaacccaaatctcaccttgaattataataatccccacatgtcaagggtaggaccaggtggagataattgaatcatggggatgcttttcccccatactgtccttgtgatagtgagttctcatgagatctgatgggtttttttttcattgtttttatttttattttttattatactttcagttctgggatacatgtgcagaacgtacaggtttgttacataggtatacatgtgccatggtggtttgctgcacccatcaatccatcatctacatcaggtatttctcctaatgctatccctctcctagccccctactccccaacaggccaacaggccccggtatgttcccctccttgtgtccacgtgttctcattgttcagctcccacttaggagtgagaacatgtggtgtttggttttctgtttttgtgctagtttgctgagaatgatggtttcccaacccaaatgcccatcaatgatagactggataaagagatttgatgattttataagggatttcccccttcgcttggctctcattctctctcctgctgccctgtgaagaggtgccttctgccatgattgtaagtttcctgaggtctcctcagccttgcagaactgtgagtcagttagatgtcttttctttataaattatgcagcctcaggcatttcttcaaagcagcatgagaatggactaatacagatgggaattgaaagatttataagacaaaaagtacaacataaggaaatctacatggaaatgaaaacacgttggtaatgtacagaggatagtctacatttcaatttgtgaagagcatgaaatacacacataaagggagtaaggatttcagttatgtataatggaactgtatagttcacatacaattcctgacaaatggaagcttctgtgtacctattccttgagcagaggaaaccatgtggttttcatgttatttgcccacttttctaacctctttcttgtccatagccactacaatctgcagtgggcagagtcctgtgaatagcctgttgtggaaagccctgttctctcaaacagtacagattactcagatgaatgaggttttgtctcctggaaaattgaacaatgaaataaggagacaatcaggcaaggccaagggaggcataacagagaaaggccaggaggcagagaaaggccatgagggagcagtggaagcagaagttacagctattttcaagtatagagaagctgtgattaagcaaatgtttagtggatgtttgagaaaagactgattgaggtgagaagataatacagccaataaaggggagtcggctggtggagggataattagtcaaaaaagacactgagagaagctgacacttaatggatacctaagccacgttaatgaaggtgtcataaagtcaggaagatgcaccaactccagctcttagggcttttggagcaaaaagttgagaaagagctgtgtggatcctgaacaatgtaaaacttctcttctttgattcctatgagaatgtttttctgccttattgccatgtgtagctacattataaatccccattatttaagactgcctgagtgaactgctgatgcttgcaattcaaagagccttgtacaatttgccctctagtccttagcttcctcaactatgatgcatcagatagtggacttgctacatgttttctaaggccctatatagtgatgaaaaaaacctatgatttttttgttggatgattacttgcatattttccacatagaaaagtattattgcaaagtagcccattgttatattttgacagctggggacagaaaaaaacttgtttagtgataactaatgcaactggctttttttgtcctttcatttcatttggtgcttttgtttgatgttgtatgtcttgtccatgaaagatgctaccatcctggaaagatgggaatttaattgctctcatcaaacatattgcctaataaattgcttactctggcagagaaaattaaaagcagctttgatgtgaacaaaagcttttttaatatggcagattttatatgatatatatgtatataactagatttctttatatcatataccatctgtcattgagtattggcatgatggctgcagttgatgtcatgtgcataaatacaaaggtaaatggatcttgttttgtgtgtatgtactattttaatatttttctgttaaagaaaaaatatgattataacattttgaaatgaatttgtatttataagatagagaaatcttgtaattccacttcatttgtaatactcagttttactttcctagatttagtgatgcaaagcaggtcacttaagagcaatattaaaataaggcaaactttctcctctcagttgtgcccatctactcaaacacaattcaaattattttatgcattagtagaatttgtttctttcactctagaggaagatttttcttcaagaaaatcaattctcaggttttcaaataaaaatggtctagtttaatgcaatttcacagaacttattttttttctcataataagactaaaaaagtctgctttgtacatcaggaaatatttccttagcattaggagacagtagcaaaactaacatttttaatgctgtaagaaatatgaatataggactatttgaggaacaaaatctagaagaacaaagtcaaaagaatgaatcatttcttctgtgaagtaaataagcatcaaagttgttactagctccttctgtactgtacaattgtttcaatttgtacatctttagagaatataacagatcttctaaatcagcataactacccaaagttataatatacctagaaaactcaaagagaaagagaaggaactggcattatggataagtgcaatgaggcattcgcaactagctacagttgtgatttatttacaactatgtacacacatacacatcaaaaatgcaaaaatgcaagattacagaacctgacttttagttacataatcctcttttatgtagttacatcaccacttactgaaatgttgagatttcagtaagtggagatgtaactacatataagagaattctcgttagtaaaccagcatttctcatttcctaagctctgagtaagtaccttttcatttgaaaagtgaagtagaaaaatccaactcaaatacttatttctcagctatatgaataattgagcaagtttataataatctccttataacccttaggcatgattataatgtaaagaattgagatttccccaaaataatcaacattaataaattagtaagatagacgtttggtcaaaagttatcgaattttcaaaatcatttgttgctatgtgtttttggtaaactttagaacagttttttaaaatagatattaaaatgtctgaaattgtatatgtgtgtttatatacgtatgtgagtatgagtatgtgtatattcagtgtacaagaatgttagtccactggtccactatgataaaacatattcatgtctttattcaatcattcagtcattcaacaaatagtggctacagagtcaaatgtactatgccatcttgtagtaatgagtaatttacataccctaatctcaagcaattcatatcctcaagaggatacaatacaaataaaaaggtagcacaacataatgaggtaaatgtgatacagggtattcatagaattgtttccacttaaagaacacatgcaattgatgtttcatattaagggccttgtgaatatggtgctctaggcaaagagtataagtgaccatggattaacttctaaatgcactgcaagaaattggaaccaggtggaaaaaggtgacacattatgagcaatgatgaacaaagaattggcaaacaaataggcaaatataaataatagatgattcagaaaataagtttgaggcagctacagtgaagacaaaagtaaaatacaaaacaggaataacagtatcattagaggtaagagctgtacaatcatgtggtggagcaagctaacataaaatttttcctcctggaaacaaaaaatgattaacttttgaacaagggaggaagtatatttttaaattactattattaaaatataaaattagaggaaagaaaagagggagattaaagccaactcattcacattgcaagttactgtaacaatgcaatgctgggttttagggttgaggtttgggagtttagtcctgaagctgggcgcctacacctagccatgtgtgcttctattctcacccaggaataagaagcaataggtcagtgtagggcataaatttggaactgaaacgcctgcataaagccaaaacctgaaatagatgagtcttccatggaacagagactaaaaaataactcagagaaagaaaagtttgactctacccaagagtatgaatcgaaaaaaaaaattctttaagaaataaaaattcaaagtttgtttttacacagcatataatgtatacattttactctcctcatggtacagagatctccaagtagacattgtaacataaaaagtgatcttgaggcaatgaaacaccttggacatctggaagggccaaatccaaaactgctctgaaggaacatttccaagctacctggaagtagagacccatagggaaaaaattccctctcaggatgagtccaactccctctccaccctgcaccatgacaaaagtcattgacactgagagttagaaatcataagtagatgcctgtaatccagcactttgaggggctgaggcaggtggattgcctgtgctcagaagtttgagacgagcctggccaatatggcaaaaccccatctctactaaaaataaaattaaaaaaaaaacaaattaaaaaattagccaggtgtggtggcacatacctgtagtcccagctacttgggaggctgaggcatgagaattgcttgaacccaggaggcagagtttgcagtgagccgagatcctgctactgcactatagtctgggcaaaagagcaagtctctgtcttaacaaaaaaaaaaaaaaaaaaaaagagagatatcaaaaacagaagagtcagcaaccatgtctgagaacctgaaataatgggacaatctgggaaagaacatgaaatatggatttaaactcaatggcagcaagaatctttttgtccattttattcacagggttgaggataattctagaatttgttgaatggattgatatgtataaaaactaagaaatgtaaataaaaatagggttttaaaaatgaatatgaaagaaaaaatgaacaggcaaagttgaaaaagaacaaaatagaactgctggaaatgaaaactatagatattaaaatttagaaatataagagatggtttaaagggacaattggacagaactatgcccaagaaacaaaacttggggaaaattccccaaatgtgacacaagtgaaaaagaggtagaaagtatgaaaggataattaagacatacggagaattaaatgacagaatctatcaatctatctgtctgtccgtctgtctgtccctccgtccatccatccattcatccatccatccttcctacctacttacctacctacctacccacctatctgaaataggatttccagaaggagctgagagaaagaatgaggaagcagttatatttaaggagctaatgatagataaattttcagtattaataaaatatatgaattttcagattggaaaccacagttaattctgagcagattatgtaaaagcaaatttaagtattgatgttatgaacaaataagttataattagttgaacaacaggtattagaaagcaacattggaggctagaaaaccatagaatggtatcttcaaactgctgagaagagtaattttcaaactagaactctaaatcagaattgctaaattggtgatgaaaattgaggctaaagtacagttattttcaagccaacgaagactgcagaggtttctatgcacagacactctctgaactactaaaaaatgcacttcaggaagaagaaattgaaactaggtggaaaaggtgacacatgagcaagggtgaacaaagaattgctaaacaaataggcaaatttaaataattaatggctcaaaaataactttggggcagctaaaataaagaggaaaatataatacaagaggaataagagggtatcatgggtaagatcagtacaagcattctcagctctttgtgttagggggcaaaatagacatttccattagtcttttattttgttagtgtaaaatatgaatataacctaaaatgtaaagatcatcagaatgtaaatagatgcaactatgaagctaatagagtggaggaattaaacaattgatcaggctatcgataagaaaaatagaaaaaagcataaactaaaaacaaccaaatccaaggaaagatgtatatgtaaaagcttgaaagccagaaagagcagtcacatgtgagagctgcaaatagttcaaaatgactggagaagaggcaggttgaggtgtgcaggggcggggaggatcagggtacaattcaggataaatgtagaaaggttatcaagagccataaatatctttatgttcatatcaaaaagccacagaattgttctaagataaggttggagtagcaaggcctggtggcacatacctctagtcccagctagttggaaggctctggcaggaggatcacttgagcccaggagtttgaagctgtagtgcacaatgattgcacctgtgaatagccactgcactccaggctgggcaacacagggaaactgcatgacacacacgcacacgcacacacacacacacagaaaagaaagaaagaagaaaagaaaaaaagtgaagcagcccatatttgggtgcattgaaagatcattctaaacatggcacatacatacatatgtaacaaacctgcacattatgcacatgtacacaagaacttaaagtataataaaaatatgtatatatttaaaaaaagatcattctagcttaagtgaacaatacgtggaaaagacatactgaaggcaagaataccagtgagcccagggaaacacaaaaatggcacaatgtaaggtggtagcagtgggaataaaggcaagtgacagattagggaaaaacaaagcttaagaattaatataatgattatgtcatttataattaataaagagtgattgggtggtgaatgggcagaagaatatgggatgaaacctaccattctggcttggatagtggagtggagggggctgcgattcactatgacactgaacaggtaattagcaacagttttgtttgttgtggtttttattttaaaatcaacagataactttgtatggatttatgtataacatgatgttttgaagtatgtatacattgtggagtgactaaatctagctaattatgcattaactcacatagttattacttttgtggtggcaacaccgtctaccctcttttagaatatttttaaaacacagtatgttattaactatagccaccatgttgcacaatagatctcttgaactttttccacctatcggaagttttgtaacctttgaccaatatctctccaacacccacccaccaccacaactattctagctgccagtaaacaccattctactttctacatctatgagatcaactcttttagattccatatctgagggggatcacgtcatatttatttttctgtgcctggtttatttcacttaacataatgtcctccaggttaatccatgaggatagttttaatggttattaaattttcatagcttgaaagaggccatgttgagaacatttacacctcagaaaatatgctcagtattggtttttatttttttgagaactggtttactagctcatgactgagatttggacattggagctggaagtaatgattgggacatcaaaatagagatgtccagcagctgatagattaaatatatctggagccatggagagaagtagtttggaaacaaagatttgggactcaagaattgtgggtaactggattatttatttactaattcaacttgtttacctacttgaaggggaaactaataataacctggataaaataacattttaatatttgatgtactacaaaaggtagagtgatttttgtctttgctttatactacatactgtatataaaactgtattttcctgtctatggaatatactcaggatacatttaggcatatttctttattttaaaaacatagtatatttgaaggaaactcaggcttgtttttcctcaatttgttattgttgtttataatatcatttaccaaagttaattctgtgatggactgtaccagttatctgcttatggcatctcagctccaaatctactcttcttttttcctgctttgtgatactgaagctgggccctacaaacatttctcctttgtcaggtaactcagtgttaggttttgtcaataaagggcattggagagcaatgtacagtatagcagaggaaaaggcttctcttccaagttctggtatgattccttttttctttgtagaatgcctgtggggacaggtatgtggggagactgtggtgcttggcctttagtgtgttctccaacccctggaaaatttctctagcaccccagcagtgattggctgactccatcccatgggattcagaaggcagctttctatatacccgttccagcccacagtgcttcagtgaacattgtaggcaacctgaagggcagctttcagcacaccagctctgacccaggataccctcacacgtatttttgtcatcctatgtgctgtagtcatactcttcctaacgagatcttaatatcatctttatggaagagggatgggagagcttacaatttggccccttctttgggttttctcacttaaccctaaggtacaatattctccctaaatctgcaatgcctatattttttagatttttaaaaattcattttagacattaactatcttttactagttaataactctctttacatgaaattttatttttcctgcttcaattattggtgtggtttgtgtctcttccctggaccctgactaacacatggaccatgtaagaagttggtcggaaggcagaaacctccctatgcagaaaaataaaatatcatccttttctatgaaataaagaggatgcttttggacacctattaaaataatagcgaaggacttttatatttattatatatatggcatttttctgacctgcatttttaaattaatgtatttttcagaatcctctgaaaggttctgactttctagatgcagcattgatttcagaagcaatggtgaatcttttttgttccattttttttttaatttttccgcataagtctacataatggtcatttctacctttgtaacttggatttactataatttccacttagtatttctctccttttttttttgctcttctaatgccgatcatcctttatggtctagctcaggtcatgattctttccaagcttatctaccctccccacatgcagattatctactactctttatctgccaaatcatatctcaagagccatctctaatcaacttattgaggtatttctcatgtttccaatgaaatattaaactatgaacctttgtggaattttatacttctttatggggaagttattttttctctcattttcttctctcaagactatttttttcttttcacatatttaaaaaatgttttaagactgattttgataagaacagtatataatagtcccatattaaaatagaagaagtggattaacagtgatgttaacaataagaaatgtactgttaacatattaacagtgaaataatgaagtatggtggggaaatgactataaagcaaacagaataacaattaaccttaattgagtttaaggtttagctaagagtttctgggagtcaaatgaaaaagggaaatacaatgggctttgtatttattttacatttttagtcagagattatattcattggtgatatggtttggatgtgtgtcccctctaaatctcatgttgaaatgtaatccccaatgttggaggtggagcctgatgagaggtattggatcatgggggcagattcctcatgaatggcttagtgtcatctccttgctggtgaacgaattcttgctcaattagttcatctgagatgttgtttaaaagtctggggtctcccctcaatctctttcctactccctctttgccttctgccatgattgcaagcttcctaatgccctcactaggagcagatgccagcatcatgcttcctgtacagcctgcagaaccatgagccaaaattaaactttttctttataaattaccatgcctcaggtattactttatagcaatgaaagaaatgactaatataattggaaagcagactatgaagtggatattattgtgcaggaatttctatagggaaatggaaaaaaagcaggattgggcaaatggaatgctccgaagctgtgatgaccccttcacagttgtcacaagtaggggtgatggatctgtgtccttatatcctgacatcctggcattgatcagttattagatgtgagttacctagaaaggaggtatgctttggtaaaaaacttcagctgaggcaattcctgggaagaccagctgacaacatttccatcagctgaaggaatgtatccttcagtgttgaaagcgattctggaagtcatgggatagaattactaatatcacatatatatatatatatatatatatatatatatatattgctttttcacagacaagcactacgtctatcatctctctttagcaggaaggactgggctttgcagaattgttcagcaataaatttctaggattgaattgaagcaaaattatattcatgactttggggggtttgggtgtgggaagaagtggaagattaaaacacttaatttttaatggccactgatgtctcattgagagatgagaaaatgacaactgtataaaggaaatgaaaatataagtaacagcttgatgcaacagcagaacagatgctgtaaggaattacatcacatgattaattgtcaaatgagccacattaattatttgctggaacaaataaaaacaaattaccagattaatgatataggcaattgttgctgcaggagtttagctggagtggagagttagaaaaactgaacagttggagataaggctgagatatttccaaataaggaatttagattgcttctggcatcctatgggtgtttgaaggtgtttgatacaatgattgtgatctaagtaagaacttggtttggtgttggcataatagatttagaataggaagtaactgggggcagtagatcactgatagataatttccagtctggatataaagtgatggaggtgatgatgggaatagaagcaacttccttcataaagatttccctaactctctgctctaagttgatttctcccaaagcttcactatttgtttcatatattctgatctttaataatttgctgtcgtgtaatgagcatcataataataataattaagatttctgtagttatttatattttacagagtgctttcactgttcctctgactctttcaaacataccatgagctaggcaggacaggaatttcatctccatttttagatgtgaaaactaaagcccagctgcttaatgctattattcctctctcacaatattataaacttcttcaagctacagagtgtatttctatttttacagagcctaaaatagaaaggcagtcaacagattttagtaggatgtgtgggagctcatatttgaggcaatacaaactcataaaattaggtgttatagattacgctgccaaaagatgactccaagtaatattaaagttgactttttcattttttacttcccaatgagcaaagtttagtttttgaacagatgacagcttcatatgttactttaggtataatatcacatctgggggatatttcttttttctcatgctattggaaaattttacagaattttcagatagattgcgctataagtatttctctaaaatgaatatgcctccccatgaaaaatgtacatatatccagggatgcttacatcacatgaaaaaatcttgtaagaaataaaagcatatgtaaaaaacaaaaaatgtattatgaaatgtcaggtgttgggataaaacattaacctaaattcacaattcctgataatccacaagtaataagtgagtttattaattaaatgagttattacttttcttaagataccttgaaaaggaaaacattccatgccaatttagtaatgtaatagaggtagcactaaaatgttataccaagcactggaacaggcttgagtgtgccggctttatcagtaatttattttctcaacataggaaagtcaatggggttggaatagatgatctccgaattttctttcagagagtaaatacatctattccgttgttatttagtatttaacatgtaactgatgctcaagacacaataatgaataaaaaagacattttcatatcctcctggagttatatttgatggatgtattatatcacaacttggagtagaaagtgcttgtgccacacaaaaagcatagtttttcaaagaaagcacaaccataaaatgggtttaaggcaaggaaatatatagcatatgtttgagaaaaagttgtattttacttgaatactagtggaatttttagtctcagaaacaaaatgagtatagagtttcaataaagatataagaaaatcccttaccaaaaagaccttaatgaagaacaaaacaaaattggtgacaagttggctcttggtagcttctaagtaaaattcagtggagtagcaaggcaaagccaggttgaaggcatttatagtgtaagtggatggtaacaaagtggaggcagtgacatatgagttatgtttaaagaaatatttgtagtttaaaagcatggatgaaggcagatagggcggtgaattacagggaatcagaattggtgagacatctttttgtgtttttttctcttttttttcttatgttgttttatactttaagggagaataaagaaaaattttagacaaataagcatgtgggcaagatagcaaagtctggaagatcttatatcagggcaaatgttggtggctaagctttggaatatacaaatgaataaaagagggaggttaaggtaccgagaaacctcaagtaggcattcatagacttttcaataacttttaaaattctaaaaagtttagaatagccacttttgacaatgtgatgatcagtcaaaaacatgaaaaccaaaaggaataaaaaggaagaaggcaagaaatggaaggagaaagggaggaaaacagggagagaagaaaggtgggagagacagacagaaggaggggagtgatgtacagatcagttagcaaactgtctgtgaaggaccaggtagttacagactttcagtatttgggggtatatggtttgttgcaactgttctactctgctttgtaaaagcacaaaagtagtcttagacaatatataaggcaatgagtgtggttgtgtttcaatacatctttatttataaaaacagatagctggtcaagtttggcctaagggccatagattgctgacattccagccagatgatgccagattctatgtagttcaaaacaagccatattagcatggtcctatgactttcttgaatgtaagaatagggattttatatgtgtatatatatacacacacacaggtacaaacacacacatgtgtatgcatacacacacagacatatatataaacacatatttatatacacataaatatatttgtgcatgtatatatatatgtgtgtgtgtgtgtgtgtgtatatatatatatatatatatattcatacacatataaatgctagaagtcatctggagtctccaactccttgaatctgcttaagatcagtctgtcacagacccagtttttatgggccttatattttcttggtcacctatggttctgactttcttctataccagtgttttcttcctatgtgttttatacccttttatttacctctgccccggtgttcagctaaatataattcattaaaatttttttttttttttgcttttttaaatttcagctgcaaatccatgaaggcaagcatgttgtgaggaaaatttcttttactaacagagtgagggtctccaggagttctagcctcatgaatcacagagcaaacaacttcaaattttaaactgatttcaggcattcatattttcacaaggcctttgggttatcatgccaccaagacattatcagtggtcaactgacccttgcagaattgtttttaaactaatcctttttttttttcttgctgtgtccttttttttttttcctctcaggcaaaataaatgaatgaatggtgtcacgcaggattcagctaattttttcattatttatatctttgctaacaaccatcacctagaaatttacctttttacctgagaggcttaacttctaagaagtatcagttgttttttcttttttaactagggtctagcattctaggtcatctaatttgtgttatcctgtgagatcacaacaactctgtattgtatggttggtattatcttctacattttaatagatgataggaagaatcaagagatagtcaaaatgggaagcataaactctttcttaaagggtgagtgaatgaaatttataatttggtgtctatgggaagtgggcttgatgatactctagatttagattagagttaattagtagcacctcatttacttttgactactttctcagaaaagtaatcataaaaacccttaaatagaggcaatgttttaactgcatggagaaagaaatggaagcagcaattaaagctcttctagaacccaggagtacttttcttcaataaaaatgcagtgatccctggagcagtatagccaaagtaggtaactcttttttaaaatgtctttatgtagaactaaaaatagaactaccatttgaataaccaatcgcattacaggctatatacccaaaggaaagtaaattaatctgccaaaaagacacatgcacttatatgttaatcacagcagtattcacaatagcaaaggcatggaatcaacctaggtgcccaataatggtagattggataaagaaaatatggtacatatacaacataaaatactatgcagccatagaaaacaacaaaattatgtcctttgcagcaacatggatgcagctggaggtcattatcctaagtgaattgatagagaaaaccaaataccacatgttctcacttataagtggatgctaaatattgggtatacatgaacataaatttgggaacagtagacattaatagaggggaggaggagggaggggaagaaaggttgaaaacctgttaggtactatgcttactacctgggtgacagaatcatttgtacccagacctcaacatcatgcaatatacccttgtaacaagcctgcaaatgtattccctgaatctcaataaaagttgacataatttttaaagtatctatgtaaatttaaataaatccctatctgaacttaagttttgtgttgattttagtgtatactgaaaagacagggtttggttcaccattatttaaggtctttagtagttaatactgaatcagaatttaagcccattgaaatgtaaacctcatgagcacaggaatttttgtctgttttgttcaatgctctattctctgacacaaagaagattctgaatactaatttgttgaatgaattaatttagaacttcttcagttttaaacaaagttaatgtgaagccttcagagcccatttggtttcctgcagcattcctgtgcatactctgtgcccctggcctcacccttttcttccatttcaaagcaaggacgttctctgtttttagtagaagagttgttaaaaagacagcattgaagaataaccaagatgtcatcagggccactcagcccttttcaacatctttgaggattctgtcctgcggtggcgctggtattttactgagtcacctctggctatagttgctttctctgaattctctcatctcaatctggtcgggcagctgttatgacatcaccccaaatatgaacaaaatctctagtccttgattatcccaaataccacccacacaaagacatcagttatgacagaatgtactgactgattgtatggctagaaaatgtttagtaacttttcaactgaactgaatagtaagcctttctatttttaaaagtcatttggataatgctctctctctttccttctgcattttcacttgtattctctcttgcttgtatataaacctggcttgttgctgagctagctagtcacttcaatacccccttttcaatcttcttcctagttcatttgcccttgtctacaacctcctttaatacgttgttagcagaactgtttgtctttcctttgtctcaactcatcctgcgggcaacaccagttcagtatttaaagatgcatactccagactgagactttattggtgcaagtcttcctctactttattagctttgtaatcttagaaaacttacttttcttttccccagttacatttttatttgtttttttgcaagcttgtaatgaattggtgaatgtaaagcatttagaaaagcatggtgtggtagaaagctctcactaaatattattttacatttttgtcttgctccagggctctcttccttaataaaaaaaaaaaaaaaaaaagaaagaaaaaaaatttaaaaaaaaggaaaaggaaaaccaaaaggaaaaaaaagtattctacaatgactttcactaaacagagccaaataggaccaccacaaggaattcagtagtcagcaattaaagtaaaattatttcttccctgctaaagaaagcaagtagcagttttttaacaccagaggctattatgtcctcattttggtcagttaattttctctttcctgtggaaagtgatcatcataattttatgttttagggctcaattcactatttttcaacattaaattgtacaatttaaaaataattttaattttaattttagattcatgagtgtatgtggaggtttgtatgtggctatattatgtgatgctgaggtttgggatattaatgatttcatcacccaggtagtcagcatagtatccaacagttagtttttcaacccttgtccccttccctccctccatccccactctagtagttcccagtgtctattgcttccatatttatgtccatgagcatccaatatttagcacccacttataagtgaaaatatgtggtattgggttttcagtttctgcattaatttgctcaagataatggtctctagctgtatccgtgctgctgcaaaggacaccattttgttcttttttatggctacagattattccatgatgtacctgtattatatttcttgatcagtcccctattgatgggcaccttggttgattccctgtctttgctgttgtgtatagtactccaatgaacagacgagtacatgtgtcttcatggtagaactatgtcttttcttttagatatatacccagtaataggattgctgggtcaaatgatagttgtgtgttagttttttgagaaatctttgaactgttttccacaatgcctgaactaatttatgttcccaccaacaatgtatacacgttcccctttctctgcagccttgctagcctctatacttttttataatagccattctgactggtgtaagatggtatctcgttgtggttttgatttgtatttctctaatgatcagtgatattgagctttttttcatatgcttgttgaccacatgtatgtcttcttttgaaaattgttcatgtttttttgcacactttttaatggggttgttttttgcttgttcaattgtttaggcttcttatagattttggaattagaacttagtaaaaggcatattttgtgattcttttcttctatcctgtaggttgtctgttcactctgttgatagttccctttactgtgctgcagctccttaatttaattaagtcccacttgtaaatttttgtttttgttgaaattgtttttgaggacctaatcataagttctttctcaaggccagtgtccagaatgatgttacctaggttttctactaggattcttacagtttaaggtcttacatttaaatatttaatctgtcttgagttaatttttatgtaaggttaaaagtaggaatctagttttattcttcatatagctagccagctatcccaacacaacttattgaatagggagtcctttttatcattgcttatttttgtcaactttgttgaagatcagatggctgtaggtatgcaagtttatttctgggttctccgttcttttccactggtctttgtggctgattttgttccagtaccatgctcttttggttattgtagccttatagtacagattgaagtcagataatgtaatgctcctggctttgttctttttcttagggttgctttagctttttgggctattttttggttccatgtgaaatttggaatagttttcttctagttttgtaaaaaaatggcattggtagtttgaaaggaatagcactgaatctgtaacttgctttgggcagtatgaccattttagcaatattggttctttcaatccatgagcatggaatgtttttctatttgtttgtgtcacctgtggtttctttacacagtgttttgtagttcttcttgtagagaactttcaccctgttggttacatgtagttgaaggtttttgttttttgtggattttttttaagctaattgtaaacgggattgcattcttgacttggctctcagcttgaacattattggtgtgtaaaatgttactgatttttgtaattggttttgtatcctgatactttactaacattgtttatcagttataggagccctttggtgaagtctttagggtattctaggcatagaatcatatcatcagtgaaggcagattgatttcttcttttctgatttgtattccttttttttatttctctttcctgattgctctggctaggacttccactactggcctagccacagccagcactgtgttgaataggagtgatgagagtgggcaagcttgtcttcttcagttcttatggggaatggttcaaacttttgcccatttggtatgatgttggctgtgtgtttgtcatagatggctcttattattttgaagtatgttcctctgatgcctagtttgttgagttttttttttttttttttatcatgaagagatgttggattttatcaaatgctttttctgtgtctgttgagattacatggtttttggttttaaatctttttatatggtgaatcatatttattgacttgcatatgttgaaccaaccttgtatctcaggaatgaaccttacttgagcatggtgaattaactttttgatgtactaaaggattcagtttgctagtattttgcaaagatttttatgtttgtgttcaccagggatattaggctgtagttttgctccttttgttgtgtctctgctaggttttggtagcagaatgatgctggcttcacggaataagttatggaggaatccctccttcttgatgttttggaatagttctggtagaattagtaccagcccttctttttacaactgatagaatttggctgtaaagccatctggtctggggtgttttagatttgtagtttttgttactgattcaatttcagaactcaatgttgatctgttcagggttttagttttttcctgattcagtcttgggaggttgtgtgttttcaggaatttatccatttcctatagattttttagtttgtaggcatataggtgttcataatagtctctgaggatcttttgtatttctgtggggtcagttgtaatgccaccttcgacatttctgatgatgcttatttggagcttctctttttttcttggttaatctagctagcaatctattgatcatgtgtatcctttcaagggaccaaattttagttttattgattttttatgtatgggctttgggtcttaattttattcagttcctgtctaattatagttattttcttctgctagcttaggctagttcttgtttttctattatccctaggagtgatgttaaattgtttatttgagatcttactaacattttgaggtaggtgtttagcaccataaactttagtcttaactctgtttttctgcatccagagattttggtatatgttgtgtatctcttttcatttatttcaaagaatattttgttctctcccttaattttattgtttatgcagaagtcatttgggagcaagttgtagttatttatttctgtataattctgtagttttgggagatctttttggtgttgattttgatttttattccactatggtctgagagtatggttggcataattccaatttttttcgaatttattgagacttgctttgtgaccaagcatgtgtttggtcttagagtatgttctgcactttcattgtatatatacagtaaatagggttttaccttactgagcagaaaaacaattcttctttttctaatagtctaagatactagataatacctcttaagcagaaattatttcattatttcttacattttaaaaatttgaattatactgattatcagagggagagaatgaatgattagtttttttttaaagaaatggagggtaatttattgattatacagtgtatctccctacactttacaaatgaagactttgagttcattggttatatgacttgcagaaggtctatgtttcagtgcctggattggagtcaagcaactcagaatacttttgtacctgcacccttccttgttttgttatataactctagaataaaataaaaagccagtaagtagtgcttaactagaatcagtatagaaagaaacaatcctgctttcacacttctcccaaaggacaatgttcaatataatatggagtcaacttttatttgaattgttgagtgatttgcatcatattagtcatagctctaatcaaacagaattgttttttggaacaagattatcatctctatcttctctatatcttctactttcttatagcagggtcttacagaaatgctcaacctacttcttgttgactacattcgattgttgccttaatttgccttttgagggtccaaattattattttaatatataatcttcctttgaacagacataagtcaaatcaatgacaaaatccctaatcttaaagatcttatcatatacctgaaaacactggatgtaaaatagacctaagagagtaaataatcaacatatacacccacagtatcaactgaatacagtagaatttcacaagttcccttatgttgacatcaagccaaaggggatatgtagttaatttacctaacttaatcacaataaccttagaaggaggtgagaattttattagaggactgaagaaagaggatagaagtatgagctggtggataagacagagtcttgtagatcattggaggagagaggaataaataaccacgatttggaaagcaagaattttggttgggctactgaagttcatgtgatgagaaagaagagttacctaattttaagaatggagtgagattgggtctaaagctatttgtgaaaaaaacttaaaggctactctccgcaaagtctgaatataattttatgatttaacatgtttttgcttcttactctcttttggcaagaacttcataaactgaaaataactcatgaatgaattataactagtatcttttcatgttttaggagctccatgaatttataatgaattctattctttgtattctctgtttgagtgatgaaagggtcagaagcacaatttataggttaaatgatattagagaactatgtattgtgtgacatatttcattaaagaagaggctatgagctggggctttaacaaccaggaatttcacacatctggccagcaatcttgttcataactacttttataattgctaagaataagaaaaaagaattatgtgcatgcatttttttttaaggtttacaactgcagtttctattcagagtagattttagtggtgagggggtactgtgcccatataacatgtaaatataaagtataataattactttgataatactcatataaagtaaaaaagttttgtctttataacttttctgaaaatatatattagcatactagcactgtactaaaattaaaattctttcgaggatttatctttgttaggagtagaaaaggttagttacaaattatcccagaaaattaaaaagcagattgaaccctttgtttctcattaaaacattaataccatttgaaaactctgcttaaattctctgttcctaaaattaaagtatttaaaaatagaaatataacatataatatataattacaacaccagctgcatgtatatggatatatccaatggatgatattgacagccaacagtaaatcaattttaaaaattttaggcatcttccatttgcccttctgcagtcatgagatttcttgggagcctaatttaatacacatgaaactatgacagaaataaagaacaaggcaagacgatctataattaagtgatgaatgccatagctttaagtgctgttggaatttaacagaagtaaatacagcctttgagaagaatagccattttccaaattttgtaacactcattttattcattttaatcaatggccacagggaagtttcagagccgaggatgataaactatgctatttgaagggctgttagaagacaagaagattggttaattatccacataatgatagtttaaaaagccaataatttatttagatatgtaatgacctgtttgatgatgaacattttttcctgctctttgctaagcaagatatgatatcttattttcttcgtagtaataagtaacatttaaaacataatattgactagcttccctttttaggcacaattaaatataagtccccaaaccagcaggtagcttgaatcttcaaatttaaaataggtgtagaaatttggagaaacgacaagaacaatatagtaaaatgggaaggatttacccttgctaatgatttttggaatcttacataattagtgaatgaaacaatttcattaattttgacacctatcttttggctggatatcatcctatgacagataaattgttactattttcattccttaaatctatttatattttttaccacctctcaacacaatgcatatgttgtggctgaaatacaaaggaaaggcttgatgcttatgttcagaaggcctgaatttaagtcctggctatattgtatccctgctgtgtgatcttaaacaagttacttaatttctctgaatgagatttgattactcatctgaaaaatggatcagtactgatactttccttacccagtggtgaatccatgcatgcttatggaaactgttaattaccaagtgctctggattcattagttcttctgtattctctttcttactttcctccttctcttcctttttctttcctttttttcttcgtcttctttccaatatctgtccatattaacgcaggtatttaaaataaaataaagcttaaataattatatctatccatattaacacaggtatttaaaataaaaaaagcttaaatgattatattttaaattgctacatgttggatctgatttttaaaatctttaactaccctggacccaggaggtggggtggcagtgagccaagatcgtgccattgcactccggcctaggtgacaagagtaaaactccgtctccaaaaaacaaacaaacaaaaacactttaactacattttttccttttatgtagatatttagaaggtgactatataccttcaatgatgaccttggtagaggctcaaatcagtgttatttctttttaatcatttttttctaaccttgaataaaagccatagagaattactttgtagagagcaactgattaacataataatatcacagggtagaaatataattactggattatttcaaatacatttctgtttctagaaagtagagctcacttcctattcttgggtaagatgtggcattaacaagaaaggcagtaggctgacagaaatccatagttatgatttttgctgttcagtacaaggtcaatggttaattaagtcaccaccagtggaaatttgatcacagatgaggtctccaactttgcccatattactgggctctcactggatgactcagctaagtcattatattaactttgcttcctccagacaggtacatgactcaaactgggctgacaggggacttaggttgtggtgctgtaatattactttctagacactgtgattatccatttcagaaaatacacattcttctcagaaataggatttaattttaaacgtgtcgtttgttatgaaaattaatcacctaatgtcatagatagattagattggcaagggtcttatgggtacctttattcactgatctgttaaatactgacctcattcatttccatgaatattggaatcattgagtatctttcatgtgctcagcattgtgctgggcgctggagttagatagaacagcatgagccttctttctcttgagacctttaagctcctcagatcacagctaggtaaactaaagccaagaacgtttaactaacttgcttaaagttcagttggctaataatagcagaaacaggactagaaccccagactctgagccacctccttgttaagcacttatcataagtaagatgacttttaatttttcttgtgagttcatataagtatggtatactatgcttagacaccttatatttgtattagcacttaaatatataaaatgcaaacaaaaggtaccagagaaaactcaggtggatttagatgcaatcagtgtacctagcatcccaagccttttcctgcattagaggaaaaatggctttgtttaagtttgtactgtcttctcagtatctttattccatgaatttgtccataaataaccttttctagcttttctctgaggtgtactttgtgccacgctttctgtgtcacaaacaggtatgtgagaagaaaaacaaatggtgcttttactcaaattaggaatatgagatatttgttgtcctctgctaaaacctaaataaatatgcatgacatcctacaaatgtagtggaaattccatctctgcctctaggctgccttcaactaggtcacactaggcagataaggatatatgttggctcttatgtgtctattgggagaaatccattcttgaaagttgggttgggaaaccgtttcagttgtggcttatgtatatttatagtgcttgcatttattcttttgctgttcccctgtgtgaagcgttatatgggttcattttgacaggattggacgaggcacaatgtgttaacctcttttttcttgtaattatataaacatgtacactgtacacagtgacctgggaatgaggatcagaacatctgttataataactgaaatggtgaatgagagtagattttgaattgtaaagcaataaaagtcactcttctgatctgtggctttatgcaaatgcaaatgtttgaaaatgctgctgaaacgtgttattctttaacttaccagaggtagaaagagagcttgctttttattgttctcacatgggtgctcccagctagggagttatttgtctttcttggaatcaattaagttaacctttacagcaatttgtttagtagtttaagcattctagaagctacagaaaagtgtctatttaaagtagctgataatgtcaggataacctcatgctagcaaggcatatttcacagtagttctttggtatgcaatcagcatcacctacataggctcttgataaattttggattaaggaaccaagagccttttgggtacaaattaataaaatgaatgttactttcatcattcttttcccaaaatgaatgattagttgaagaccctacctaggggcaggtcatgaactcaccttgcagaggaacctttgcccattcttctgattccatgcaaaccctcttcaccacaccaagattacctttctcacgagaattatcattgtctttgccagtaccagcttggctgcaagcagaggacattttaaaagattattttaaaattatttaaaaatttaaagttacttaaaattactggttagtacttggttatacaaataatgtagcaatttttttcaatagaaaactgaagtataaaaaatgaagtgatttgcctaaggccactcagcagaaaggctgaactggactgtgaacccaagccaactgactccaagagcccttatctttaatcactatacaatatttcctattttattagccatatattctgaatatttttccacatcaataaatataaatttaaccatgcattttaacgattgcacagtattcctctggtggtttacaatgctattgtagaatctcctcccagatgatatacatttagattgtttcaattgtatttcataattaaaaatagttcttctatgaatataattgaacatgtgttatttctagtaaaatttgtctaattcttcaatagctatgtaatttgcctttcttactaatagaaatatacaaaattgcttgctcaaagattattccttgactctacatatcattatatttatattaatgcaaaaaacacttattgagcacctactgtgttacactcagttaagagctgcacattcaacatggagtaaatgcacaagaggttatagactaataattctcactaacgaattttagaacaaatgctttaaaacctttgcttgattataaatatgcagttcacttctcaggggatgtttaggagtattatcatttttaatggaaatctctcatagaggggtgtgtgtgtgtgtgtgtgtgtgtgtgtgtatgtatgtatgtgtgtgtgtgtctcactctccaccctgaacacacaaagtcccatagtctacagttgggtcatttcatttgatcttgagacatttgtttaagctatgtctacacaaagtcactgtaaacattttggtcagtgacctgctttgtttgacagtgtcacaccactgtatttttttctggtctactttcactctggattaactagcaggtttttaaagctttcctcagactgcttttatatgagtccttgtgggtatgcattagtttgcatgcaaactcatatatgtacattatttctgcattagatctctactagattagctacattatctgcaattcgaatttccacaatcagtttttgagttagatgtttagaaaagaaaagttactaaactttaactctttatttatacatttacattttccctggacaattttctacaatattttcttcccacacctgctttgggttctttcagtttttcaatttcacaggaaaaaaatacctattattgtatgttgaaactagttgtaaagagtaagaatttttaaaataaattctagttagcattagatatatcctctattccacagactgttctaattataaaaataactcatgtcattttgtaattaacaaaaggctttagcaaatacctgaggctttctggatttctggaaggaacacagtgtgatccccatgattgtcttagttgcctgcaaaaggaaaataatggccatttgatcaatttctacaacattttaatatgatgttgatacaaaaatatggctttaaaacttcattttgttttaatacatgagacactctcatatttcttctccatattagtgagattctccaaacatttattaaaaactcacactacatgtgaggcaccaagttaagtccgataagtcaaagaagagtaagccatcaaagagttttcagaggaaccatgtatggtaatagaaggttatacccttggtcctgtcagaagtagtagaaaaaaggaatgaaaaagatggtgtgagagggaacttgaaatctatatgaggaatagatagatatttatagagaagtaggcttcttgaaggagaagatgaggtgttattaatgtaatatgaatgttaatattttagcaatctcaagataatttaatactatagttttaaaaagggggaaaccaaaagtaattttaagaattttaagaaactttgccagaaaatatagaagtaaacagttgttttactcttctttgttccttcatttaaaacaaaataaaataataagcacacaaaaatatacatttatatataatagtaaatattccacctaagagcattaaaatattgcttaaagaaactgcaaagtaaataggtaagaagaaatgaaggacctatcttaaagttatagtccatataaataatagatactgttttgtatataatatcaaattacatatgtagattgctttatgaataatactattaaattaatttgcatttttataaaatattaacttgctagccatcttttaaattactatttctggattaaaactctagaatgtttaatactttcattttaaactcatgatatctaaatcatctttctaaactcaaaacatatttgcatctatattttattgattgaatttcataatattttggcagatgatttctcacatcaatgtattttttgcaaaagagagagttaagtgtcccatatttgcaaaagactggcatttaaccagatctgaaattcagaatcattattcttccacaatttactgtgcagttcttaaggcagttttagaatcattaaagtgttataaatctctgatattcagatcatttcacctgatcccttcattttgcagaagagatgatggaggtctggggagtgaagaggcttgctcatccagtcacttttcgccttttcttttcatttggttgacctattttcttttaaataagtacgattaagcacatgctttttaccttcaaatagttggtattatttatactgtttatattataattatgtgactacctttcctgttatctcagtttgatcagttctatttatatcttgatactattcaagcgtctgccttcccaatcagtatgcaggccctcttggttgtaaattgctaacatttaagtagccatttcccaattttcttctcagtgtgcagtgcctctactttaaaattaatattatttgcatgtgtattttgaagtcctcccttggattttaatggtccatttatagaaagaaaaatcaacacttattttccatccactactgaaaaataatgttggaaagtgtaggagctttgtcaagtaaaagcttatttatttttaaaataagaaagcacatttacatgccagaaaacaaccaatctttgtcaaggggctattacactatttcctgcaacttgatttcagtttatatactgacttctcactcatattctttattctggactgtatcagcaacttctttttttcaaatgcccaggacaagtctgagaatatgatagatgtaggaagatgtatgcaagtggacctttaacgtcttctctagttgaagaactgcagagagtgctagaacttcgaaaattccaggacattctgcagacaaaattttcattggttacatatttgtatagtttttatttcacctgaaatattgacaaagtgctaatgtgtatgctttgatgagataacttagcaacaatgaagaaggttattgtcattagaaataaggttgaaaatactggagccagtctttttattaaatcaaaaatacctgttgtttcatggctcaaatgactcaaaagcaagtaggaagggtgggagatatttttcagcgtgaagtggagaccagacactcctcctcgcctggaaaatgagtacattacgctatatactttccacataatcaccttttgggaagctgtcacctacttatttatttttccatggtgtgtccacgggtcacatgtatatatgttttatttttgttttcactttttaaccagcatacatttaggcactcaccaacttcacacaaaattaatttcaaattgttatagtcatagtttatatggacataaaactcttagaatttgttcaaagaaacaaagtatttaccacttagaaagaggaaagttattgagaaaatagccagaagttgaggataaagagtggcaatattacccagcaagaagcaatacagaatggcaattaaaagatggggcctggactgaggtccctcgtgtcttaatccagcatccatcacttgccaactgtgtaactgaccttaggaaggcactgaggatgctagacctgtttcacggtcttgctaaagcagaattcaataagctcagtgaagcaggttctttggactaagaattaatctaccttgcaggactgaaacataaagaagaaaaacaaatcttagactcagtaattgggacaacttaaatattattatattcagacttaaaatataaattttatttgatgggaaatagattaaagacagaaaacgtgagtcaaataaactttttgatgactttttattaatgtttgtaaaatacacagtgcctgatgtagcgtatgatgtcaataaatgttgactgttaggaactttcattcttcaatgagattgagcttaggtgtaaacatgtttcatacttatttaaatttctttagcttcaaattgcaggagtttgcattatgtttgaaaggggtctggaacattgagcacataaagcaaagacacaattagttcagtgcagttaggaccagtgaggaatgttttcccagaaaaggtgactatttcaaaagctcacaatgagagataaatttacagatgtatgtgttaatgtgtgtgtgtgtgtgtgtgtgtgtgtgtgtgtgtgtaggtacataggtcagtaagaagaagctgggctcctgggcagatgagccctgtttggaaagcaatggaggcatttgattttggttcaatcaggtaaaggtaagtggtttaatatggctgtatgactggggaagtgggagtggtaagaaaagaggttggaaaggaaggtagaagacaaattatgaaaaactttgtaaatagcattaagcttaaagattagtcattgaaagattttaggaagttgaataataagatcaatgtttcacgttataaaaatgactttgattgtagtagctataaactactgaaaaaagctagaataggtgcaagtatccatgaaaaatccagtggagatgcattgttgtggtgtggaagacatagaacttctggacttagtcaagcatatgaaaaggtttacagtgacattcctgtagaaatgatgggaatctataaactgttagctagaataattaagaagaccattacctagtttaacaatagggacagactccagtggggtatctatgaggttatggtctaaagctttgcttggtctttaactctttctggcttatgatttttatcactgacttagatataaaagcaaaactgaatatgacctaaaggcagaaggtaaagaaacacatttcacatacctttgtaatattagtaaattaccttgatacattagatgttgaataagttaataataacagttgatgatagaattaggccccaagtggttttaattagaaaattagaccaactgtaagtaaaagatattaatcagggatacttgtaaaaaaattttaaaaaagtacatcacaaacataaactttttaaacaataagcttaagatgaatgagcagtgtgatactgtactgttaaaaaaatccagtattttatctataatacattaacttatggagctggccactctctcataatttgctttgcttggatacacttggagtataacattgaactgtggacacactaggctgtgttcagaaaaaaaaaaaaaactagaaaaacgaaaggatcagattagtcatgtgacaaacagttaaacaatttcaaagtgttaggctagatgaaagaaacgcagtaggaagatgaaatgttttcaaattctggaagataatcatgtttaagttgggattaaatgtatctcaataaaaagatatgattaaaaactttaggaaaacaggggatggattaatatatgggagaactttgtgctggagctctccagagaggtgagggactgcttcagatgataagtttgtcattcctggaggccaatgtgtagtaataaaggcaatctatgtatctgaatgatgagtagaccagatgatttacagattgtatgattcttagactccatcttttacactcaggataatagtgcaattttagtgcatagtacatgtaaatatttgcaggttaatttaatggtcattttgagaagtctgttaaaaatatgcattaagaacaaaatgagtattggggttttatttcttcttgtccattttcttttccccccaaacttttattttgaatttttaaacatacagaaaagttcaaacaattgtataaataaacactcataagcactttgattaaacaattgcttatatttttccagttttttgtttatgatacttctttcatacctaaagacttgatctcctaagagtcaggatattttcttatataaccactatatcattattttgcctaaggagaaaaaaatgataccctaatgtcatttaatatccatggcatgtcatttaatagccaaaggccaatgtaacattgtcctttggcattatattgtataaaaattaaagaagcttgatgattttgtcctttggataatgatttgtacaaaattaaaatgcagaggaaccttttgcaattgtttagacaggaaataagattggtataacatttgatggagaaaatcaacatatcttctgggaggataacagatggtgtgccatttagaacatcagtttctttattaaattaaagtctacaaaacacagattgtactcactttaaggtaagacctatttgaaaagtctcagaggttagatgtgacgttggttggtacatccatcatgggtttatgagtcatacagtcctcagtagtagttacaattgatttaaaagagaaaggcattgactaggctttagcagttgactaatcttttatttcaagtcttaagtagtgaagttcttttgtgagtcagagactgtgatgtgaaaagtttcagcactgagtgttctgtgtaaaccagggatcacttgacatttggtttcctatatctacaaaacaaaggagggcaattgtgcccatgaaaaagaaaggtattctcctctccttctttttttcttcttttaacaagccttttgtagtgaagagaactgttaacttttaatataagcttggaaaaagaattgcgggcattttatggtttgatatagaggttatgtgagatatgatggcccttcctgaattaagaaataaaacaatgataaagctgtgagaatgattttcttagatgatgttttgaacctaaaaagttcaaggtaagtatgagaaagcagtacattttgcttgtgttgtatggagaataaggaattagatgataactacacaggagtctccagattcttgaaaatgtgaaactggttgaattttggtgtaagtctagaaagagcacaaaattattgattactaagatgcttctttaagatcatataggtcttatgagtcctttattattctgagatatattttatccatcaaacatgatttatgaactctcaggagagcaattatctcttcatggatcacatgcttatgaaatactatgtacaatcctgacattataataaaaagaataattctaggagaaaacagttttatagaagattcccagtacaaaatggatattattttttcaagtcataggaaagaaaaacatcttgtttaaaatcatgtgaacaattatccttttgcaggctcatgaacaggtggaaaaaatgctttgccattcaattttataatagcaatttaaaaatcaaagatgttcttttaaaattataaaaaccagctgagatcttcctcagagaatcaaatatagagagccttatatttcactttacaaagaaaatacatgaagtatatatgcccctgatttcctgcccatcttcacatctgcagattacagataattgcttcttgctggagtgaataaggtgtcctcctcccctaggcttagcctatttgccatgctttggatttgatcctctctttttcctgagacacctggctccatcactaatgccttctcttttctaccttttagctttctcttcctattggttctttccctctgcatataaatatgttaagtctttctcattataaatgaagcaaagacacaaacaccctgagattttatcttcacctttcactgtcctgttttctgctactctttaatattctagcttcattttgaagaatattcatttttttaaataacaagattaacatatttccattgttagctatttaaattatacaaataaataaaaaatcagaaagtcaaaattaatcaaatgcctatcatctaaaatgaaccaaggttaatatattgttatgcataagggcatattataactacttctgaagcattttgtcatgaaataccttctatagaataattttaaaatggctaaatatatagtattttattaagtatatctaccatagtttctgtaaaaagtcttttaccattgtatacttagaaaattttgaatcattgtgttcttataaataaagaagtgaacatccttgcagctaaatcagtgacattttccttaagtttccatcctgtaagtagaattagtgctttcaagtgtgtgatatttttaaagcttgatagatttaaaaaaaggacttcaataaagtttgtgtcgatttatttttctattcagctgtgctctttcttacacctcaatacatttgattcataaagattctatctcattgttttaattaacctttcccttttcctgtttttgaacattttcttacatttagcggttatttgcatttattatttatgaatattatctacttatgttctttgccagtttttctactggagttgtgttttcagtagctagtttttttattgaatatattattttcttgtaaaatgtattatatttaatatactttcatatattttcatatttgtctttcgttatatttgatgcatagatgtttttcaaatattgaagctacatttagtaatattgcctttatttttactgcttgtgttttcaaacttagaaaggccttagcactttcatacaattgttttttaaagtaaaattttattaaagaatgatctatgtaaagtgcacacatgatacaagtaaagttctagtaataagtatccaagcactcagattaagaaacagatcatcaccagcatcccaaaagcacatcatgctctcttcttactgctattcccaccactaacattttttgaactttttgaacaatgaaatcatgcagcagtatacttttgtgtctggcttctttcactcaatcatttgtttgtgagattcatctcatgttattgcatgtagttctttattgatgcaggtcttccatgttgttataaatattcttgcacatatgctttgatgaacttatgtacagatttatgtttatcagctatcccagagtgaaatttctgtgtcacagagtttgtatattttcagtggtagaagattcagacactcaattttcaatgttgattgagccagtttgtctttttcattttagccatgctggtgtatataaaattgtttcaaattgtggtttaaattttcattttccataataccatgaaattgatcacttttttatgtacattgtccatttcaacttatcttttggggaatgcttgttcaaattttctacccatatttctgttggtttgactgccattttctttttttgtagattctttaaaagagaagtcttttctgtctctccctctgtcacacacacacacgtgaaactactaaatgtgtgtatatatgtgtgaatccactaattctacttataggatataaagaaaatgtcatatatatatgtgtgtgtatatatatgtgtgtgtgtgttttgtcatttgtttatggcacacatatacacgtgtgtgtgtctgttgagtgtgtgtcttgtgtgtgtctctgattaggaagttcttaattttaagaaagtctaatatgtcacatttttacctttataagcatcactttttgttttcttttaaaacatcttctcttagcttttttttgaactttattttttaatgtcacatttcaatgtatgattgaaataatttctatataattatctacttaatccagaaatatttattgaaaatacaatccttttttattagaactgcagtattatcactttaatattgttgtctatatagatggaaaactatggattctgtgttctacttatctatttttctctattaatttttcatcagatactatttcattatttgtttagtctttgtcctagaattcaaaatgcattcttgaattactatgttcagttatttctgaacatagtatttctccaaatactgctaaaacattaaaatcctttaattctatttatgcattttttgcttttttaattatacttaccatacactttaattctaaacataaacttcatcagtcattcctattctttctttttatagtccaaatttattgattttcacccatgtgtttgtattttctcgtatacttcacatgttgaagcaatgtagtggcttcctctgtaatcaataacctgcctatagaacttgatttagttagtatttgttttagtggaggcttgttggtgataaatcctttcaattttggtattttcattgatatagtcaaacatatttggcaaaacacatttgtatctcttctctatatgttatgaaatgaaaataaatactaaagaagagtggatattgtagacattttatctttttcctgaccttaatggaacttcctcctcttatatataaaatttactgttcattcgtgatttttatcttaataaagtctcattattttattgttttccaaaaaagtatttttaaataaaaataattatcaattgcatttatactatctagtatggtgaatctacttttttcttcttggaacaattactaagttggatgatagtaagattttccgaatttttaaatagaattaaaaagttctttctcctcaatagtttgtaacaccaatctaactttatttggaaaccaattctttactagatttttttcatctccttccacatacaaggggtaataagctattcatgatttatctcttttctttagttaacattgttgggtggttatattttgtcttaaaaggttgcgttatctggatgtttttattacaaaattttaaactctggcttggattaataaaatatagctatttattttttaatttaaggtggaaaatgggttatcctaaggaaataaaaagatttctttaaacattcaaacttgtgataaatatgtaaacttaaagtcgaatttgaattattattttaaagattgataaagaataagaaagtttcaattcagtatcatcaaatattgattcaatattataactgggtaaaatattgatccaatattataaaatatgatctttattgcatacttttattacatagaaactaccattttgaacgaaaaaagtagaagattcagttttttgttttatttgccagcaagaaaccacttaaggcttgcatttctataattttctctttatttctacttaactttacaagtaccttacaattagttaactatttttctgtttcatatataagatcttacatttttagttacgtcttattaagtcatcttatctcacattttaggaagttttgtatattttgcctgactgaaattttgcagaaaactactagtttgtagtggaacaggcaagggttttgaagtcaggcatgagcagattctactagtggctctatcacttgatagctatgtgatctttgaccagaggggtaattcctgtaaaataatgctattttggatggctttgaaggttcattgtgacctcaaatacttgttgagtgcttactctgtgacagccactctaaatgttttgtacatgctaacatttattctttattgcaattctatgcagtaacctcccttgtcattcttctttcagagatgaggcagctcagactgaggttttaagcaactgcccaaaattatacagatagcaattggcaaatccagaatgttaaacccggtctagctccaaataaatgttatatataagggtagagagtaaagaagaataccactgttcttctccacatacacagaaggaatctaggttagttctttacacccattagacacatataattattatccttttgcttaacataagtcaccaaagacttcaaatatattgagtgccatttcacaagttgattgttttagtaagtacacccttaaattggttaaaatccagaataagagaaatatttcaaatgaatatggtatcaaataatattttttatcttgttcctgaatgtaaatttgcctcacccctctagtctattctgagtcctaattcctcatagttagaggaattgttacaacattacgacttcttactaatttataataggtagtttgctaatagtatagtcacctgacattcatgtgtcaaaatatctttgatgaggtatgaattgctagatgtggaatagcttattcaagaaagtttaatttatgaatgactgtacggggagtacatggtgtgaaatttgaaaggaagaaagataaatgttctgcgtttttaaagtacttgtttcctaaggacagaggttggaggggattaggaatcagatgctccaccttttatttcattattcaaaccaacaatgattcttttggaggcaaaggcctcagttgggtcactcccagctaacgagagagcaatgatattagagagaaggaaggttgtgacaagagtgagggaactggaatgagacagagctggtggaaggtcacaaattgaagggacatattttaaaattatactctatggccaaaattatatactagttttattcattgattaaaggagttgcattgttttggagaggcatccttcataaatgtcaagtgtcttcttaaaagggacttagaataaagcaactagcaaaatgctaactctcttttctcgcaagtaagatgctgaaatttgcaaataatttgggcttttaacacaataaatgcacggtggctcactcctgtaaatcccaacaatttgggaggccaaggcaggcagatggcttgagcccaggagtttgagactagcctgggcaatatagtgaaaccccgactatacaaaaaatacaaaaattagctggaaatgatggcacacgcctgtagtctcaactactggggaggctgaggtgagaggatcacctgagcccaaggaggtcaaggctgcagtgggctgtgatcgctcctctgcactccagcctgggcaagtgagtgactgtcttaaaaaagaaaaaaaattgtttaaaagaattttgatttctgaatggagacggaatttaacacatttttttcaatgcttaattttatagtatatatcaatgaagaggattgattattctggaactgtttacaaattttgggggggataaatttcagtacttaagtcaagacctctctatacctaggccctaaaataagtaataactaaagaaaaaaagtccaaatcatatttgtatcatgttaaattttggcagcaatactaaggcaattttaccagtatggctgtggctaaaagagaatatcccaaagttcataaagtaagcacacaccccatgtacttaaatctctccctctctctctctctttctctctctcacacacacacacgcaaatgcacttgcacatatataaaagtacagaaaacttctgatattttctttatcttgtgaaaattatgtttattcttgtaaaatttatgatttttctctttctttttgccaggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaaggtaattgatagatttttaacatctttgtttcctggaattcaaatttctaggtattcttaagagatttttttatttttcaacatacagttaataagttgttaggaatatttgcatgcaaagatttattttcaaaatgcatataaattttatcagagaagataaagtataattcctcttgcaaaaaatctgcttataacatgaaatacaattacatctgttagtgaaattttttttctattgatccttccatcttattatagaagcattcctatttttaagaacccacaaatataaaatttatatgagtggattttaccaattttgcaatccattcttacatctttatttgcattatctttcaatcccattatattattactgtggtctcaattgattggctaccttgaaagttatgtggttctaagtgacttcaaaatgtcagcatatattgaaacttaattggaaaattttaaacaaccattagtttatgtatattccatgctcatattttaaccatctaatatttctttttgtaactgaaaataaatggctgattatgtaaaaactgaattatataaggacataattagaatactttatgagttttattttcatgttataactgttgtaaatgtcaaaaatatagaaaaagaataaaaagaaaaataatttggtggaataaaaatttaatatttatatatgaaggaaggcaatagagaaaactattattaaagcatttattttaaccagacagctgtcagtagtaaatgtgtttgagaggtgcttctatagtcttatgtgggtgatcttttcttatatatgtagataatcttatagtaggtgatcttttcttttgcatagttagcatttatataataggaattaaattttataataaagatttttctcaaaggaaaaggcttataaagtgtttgttctaacattatattttaaaacaatgtttgcctttctgtaatgctaatatggttttactgtagctaccttatattggtggaaatgtacataattatttataattccaggttagtgcaaattgtttaagctcattaatattaatggtagctgacaaggtacagtatttctcgagatgaaagtatccttcttttcccccagcagctaagtagtgtttatcaaagccatactttgcatgccctttgaattcatatctttatgaatacaaataagtttccacatttcagagcctgtcaggtgatgaaaggttttgaagactgagaaaaaggttaaaggtaactgtgaaatattacatttgtcatcataattgcaaaataaatcattaattcaagactattacatttgattagtggcatagttcatgattgtttccattaggaagaagaagttctgcctctaatgaaagcattttgatcaaagaatatggagtatgagtgcagtatagataaaatattagtagatttcttaatggtgatttcaaatgaacagcataaaaaaacacaggttcggatgttctcacaacagagtactatcctgggaatgccctagcaaaattatgaattgataaagtcatgtggtttgaccaaaatattataagaaatttacaagctttgttacccaataaaaactcactgggaatcaaatccatcatttcactttggcttgaagctaggaaaagctgaaataagtgtatgaataactgtctttgtgaatgtcatggtttggattttatcttctgaatctcttgtttgttgagttattactgcttggaggacacagcaatacataaaaacataatataacagagccaatatttttttaactttatcaagaaatgtatatattgataatattgttaatgattaattataaaataactttagatattttaaaaatgtaattatttatccaatgcaagaaaataataataaatgagatgttaccttttgacattttatctaatttttttctgttatagttttaaagggtagtattgttctgctcaattaataaatactttgatgtattagagcttgaattattgtttgaatcatatatttttaaataactcttctgataaccgaaagctctaatcttgcttgaaacacacttagaaacattctaaataacttaattcagtgtttttagcttttcttggtttgtgatttgtcacaaacctggtgaaggaagatcatttatcttcagtatatatgaattaaaatctcatgttgagtgaaaaattctcaagtctagccaccatttatactaatttagaattccacatgttatttaaaaagtaagaatccatgtatttaaaaacaatttatttagatcatattgatttttaaagaatgtttaaacaagtgttctgacaataatttacttaattattaaatatttccatgcttaattcacgtataatattatattttatggagaaaactgagggaaaatagcagaaattttcacacggtagaataataaactatccattttggaggaattgagtctgaacacctaatttatgcctaaagctcagtaacaatccttctctgtcctttaaatatttgcagtgatgggcaaaccattgcctcttggggaagactatttcatttttcaacatggtttactttttttttgacacacagttttggtctggcacccaggtaggccaggagtggcaccatcatggctcactgcaacctcaatgtcccaggctcaagtgatcctcccacctcagcctgccaagtagctaggactataggcacacagcaccatgcccagctgaatttttttttgtttctttttgtttgtttgtttttgtttttctttttgttttagtagagaggaggtctcactgtgttgcccaggcaggtctcgaattcctcgtctcaagcgatcttcctgcattggcctcccgaagtgctgggattacaggtgtgaaccatggcatgaggccattatttagaattaaaaataatagccgggtgtggtggctcatgcctgtaatcccagcactttgggaggccgaggcgggtggatcacgaggtcaggagatcaagatcatcctggctaacatggtgaaaccctgtctctactaaaaatacaaaaaattacccaggcttggtggcatgtgcctgtagtcccagctactcgggaggctgaggcaggagaatcgcttgaacccgggaggcaaaggtcgcagtgagctgagatcacaccactgcactcaagcctgggcgacagactgagactctatatcaacaaaataaataataaataaataaataaataaataaataaataaatatgaagtgggtaaaaattcaggggaagcttctattttttttctaattcccctttgcccatcaagtgaaacaaacttaagcttctttcacatgccaggtcttcatatatttaaagataagttttgtgttcccaataattactcactttctaggcccaagctcgctatttgtgtcagtgtgccttatagaaagttcaggtcatggcacagtctattttaatctgaataccctctagtttgttcatgcctttcttaattactgtggttattattgatatgaataaaattttctgtgagtaaatacaaactttaaaaaatagaataatagaaaacacttatagcatccaaaagccaaatatataaagatgactgagtacttgtctaatgacttttctgtttttctactcagtgtgactgatccatatgaaatcactctctaagagctatagcaggttttgtgtggctgagtgttcgcataacccgacatgtatcatcagataggtggaaatgttcatctgtgtgtgagcatagctaattgcacgagtaaagggggaaccatgtggcttttgattaagaaatggaaaatgtaaaaactgttcagtgaatttgagaagctgcactattccctcattcccctcatataaactagtcttccaaaacaagcactgcccccttaaattaaaaaatattcatcctctctctccttgcctgtctccctcccctgacattatttatagaattatttgaacattgagctgcagggtgagttaattcccttgtaacaaacggaaagtgttcagagtcagacaaaattttaaattagtgaaaagtagatatatattttttaaaaacacaaatctttcttgagaatgatacctttgggtttaaaataataatgtggtatctgttggcacactggcacctctcctctcattattgacagacctttatctcctcttcagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtaagaaaaatcagtatcttttggagctatgctttaaatatagataattttctgaagcccattccaggttcttattgtattcttatgtgctttattttgagttttgaaaattcagctaaggggtagaaagacagaatcaaacaccaatcctaatttcacatatccaaacaaagaatacctatgttgaatacttcttctctgtatttgtaaaataagcatttttttattcctgtgaaagatcagctagtttggtaggttggatgaaagatagatgtagtaaacaatattatagatagatagatagatacacacacacgtacacatacacatacacacacacatatgtatatatatatttagaattccagtcatttaaaaagtaagaatccatgtattcaaaaacaatttattcaaaaacaatatggtctaacaatttagatcatattgaataatgtgtgtgtgtgtgcgtgtgtgtgtctctgtgtgtgtgtgtgtgtgtgtgtgtgtgtgtgtacatagacagatagatagagtcactctgtcgcccaggctggcatacaagggtgcaatctcagcttactgcaacctctgcctcccaggttcaagcgattctcctgcctcagcttcccaagtagctgggattacaggcatacgccaccacttctggctaatttttgtatttttagtggagtcagggtttcatcatgttggccaggctggtctcgaactcctgaccttaaaagattcacctgccttggcttcccaaactgctgggattacaggtgtgagccactggacccattctgaaatatttatttaaagaatttttctgctatgaagtttttgctagggtagtttctcaaggcaaagccttgtgatgagtcagtgaaacttgccaagaaattcagaattatgccttactattttatctggctgtttatgtgcaaagaatgcatataaaacgtaacaaactttataaggcatgttaaggttagaaaagtttttactcatatgtggaacaatataatattcactgaaacactcaagtttgtggaactgcttttgtgtagatgtcatttagagacttagaaaatagaatttactaaatgatatttatttcagtgagttaaaggaatattttaataaatatttgctaactacaggttgtctgctttcttatgttaatgcattttattatttttgcatacaaatggttatcttgaattatcagttaaaaacaagtctcagagaaatacaataaagtaacaaaaatgaaattttaattttcattgaaagttacattggtgatgcagctgcatactattttgcttactatagagtgataattaattttactttaagatgtttatcaacaatataaacagtgctctttaaattagaacataaaaacattttattttaggacacttcgctatactttcataattacattgagattgaatttcatttgaatttaaattctctcaaagtatgccaggagcacattttgttcatgcatgcagtatatagaactctgtgcagaaatttgcccatttgccaataaaattggtcatctgcaaattgacagataagaactctttcaagggaataggaaactgggagctacaggattaaaaaaagggaaaataatttcaaaaacattttcaattagataagaaagagtgaaatgcatctagatacaaattagagtaattttgttttcttatttaaaatgtgaaatatttataaataattaaaaattaggaatacattattaagagtccttaaaaataagtatgtttgatctctgttagctcaaattaaacctattaaatttattatattgctttcttcctaaatcattacttctttgtcattggtaaagttctgtgttccaattttgaatgtcaggttctatatgaatgatttctgtgagtatgtgtaatcaaatgatccaagggatcctcagttgcaaattggtccacttatgtttatggatggtcatctacaaaactatataaatatagatacatgtgcattgttaatctgtggattgtttacttctccattccttcctgatgtaattcatgtataggttgtccaaacatcatatatccttataatgtatacattatatacatatgtgcatgcacacaggtatgtacatcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaattatattctcaattatatcattgaggcaaatataaatagggacatatgtatagctagttgattatatacatttaatggagtcctgacctcaaatttattaaaatgcttactatttagttactcgttactatttaaaggaaactttgccactcccttggctttgaaggtgacatagacagttggatatttgaaaagtctgattagttaagtggtaatgctaacttagaattgttacagaattattcatagaataaatatgtcttgaaatcctctgaagaataaaacatattgctgttccattttatgcaacatttaattcaatgaattttgattatcaactgatacatgccagggagagttaaatgccacgaaaggaattatatgccactaaaggaaacaaaggcccagcccttgttgagcttctaatccctattgagggacatgtaataactcatatttttaatactatttgcaatgggataattgcacttgtaacagaccaattgttgcctcttactttacagcatttttgagaactttgattatttaatatgatagaactgactcgaaggcagaaaagtccctttgaaatgtatttataaatatatagtagactttttgtctttttgtttatgtgtcaaagtctcaaggtagaatttttttcaactttcattttaaaatcagggagtgcatgtgcaggtttgttacaaggctatattgcatgatgctgagcattgggtacaactgaaccaatcacccaatgaacagggtatccaatagatagtttttcaacccttaacctcttctctccctccccacgcttgtagtctccagtgtctattttttcctagatttatgtacgtatgtaccaaatgtttagctcctacttataaataagaacatgaagtatttggttttctgttcctctgtaattcacttaggataatggctttcagctacatccatgttgctgcaaagaacataattttgttcttttatatggctgcatagtattccatggtgtatatgtaccacattttctttattcaatccacaattgatgggcatcttggttgattccatgtctttgctgttgtgaatagtgctgcaatgaacatatgcatgcatgtgtctatttgatagaatcatgtattttcctttgtgtatatacccagtaatggtattgctgagtcaaatgtcgttctatgtttagctctttgaaaaatctccaaacttctttctacaatggctgaactaatttacattcccaccaaactgtacaagcattcctttttctctgcaacctcaccaacatttattgttttgacttcttaataatagccattcagactagtgtgaaatggtatctcattgaggttttgttttgcatttctctgatgattagtgatgctgaacgtttctttcatatgtttgttggctgcatgtacatcttcttttgaggagtatctgttcctgtcctttgcttacttttttaatggggttatttgttttttgcttgttgatttatttcagtttcttataggttctgggtattagacctttgcttgatgcatagtttgtgaatatttgcaaggtatagttttaatgatagaattcagcaaagagaatttgtcagcttctcaaaagagcaagatgactatttgatgatgtgataggaaatttactgtgaactgaaatgggaaaaactccacctcatacacaataaaataaacattactgtctttatgatggacttatgtatctgcttttactgcaaaacacacatgtgcttttttttttacatatttcctttttcctttccatatttatttattatgtatgctgttgctcccatttgtattcatttcttttttgttgtgttgtccagtttgatacatgataattatactttcatccagtctttgttcccacccccaaaacagatgggatgataaatgaaatatagtgctggaataggataaattcttaaaatgatgttaacaggagctatttattttttacgataattagcatttgttgttgtcatggatgaatgcttttaaacacgctgaaagtctgttatagctctgaatgatgtccaaaaatgatggaaaagaattggcttcagaaacaaagctgtgtttctgtcagtcattttggaacatatgattcattttaaatataaactaaaaataagttggctagatgacagcttgtaagcaattccagaataagttgttcatatttgctttaaaatccctgtgtttcatctttgtttatagatcagcagtccattaacaaaaaaactctggactggtaaacagaagcatgggattctattcccagttttgctactaaattactggtacaacttcagaaaatacaagaagggaatggaaatgcctgcagaaatgagctataatgcactatgaattgacattgtgttagttgctgtcacgtaaactatttcacttaatcttcaaaacaattctgtgtgtcccaaaggaaacaggtgatcatgacatcatacctgttatctccagtgactggctctcctgctcaccagagcctaaactagaaacatgaacatcttccttgattcttttctttttttggctcgacaacaatcggttgtcaattctatacttgtatgatctctcaaatcttttatttttttcctaccccctaccacttcttaggtcaaaatcacctccctctgtcagctggatgattaacagccttctaactggtctccctttttctagtctctccattgcagttagtgtaatttttttaaaaatgcaattctgatctgtttccctcttaatagcttctcattcctctaaggcatttttaagaagacttacaatgcttagtgtgatgtagcccctatacttgtccagtgatatttgagtccaaatcccccactaatttatttcaaattgagccagtagacaccttttagttgttgaaaataatcttctgtttacctgggaagctctctttctgatcctattcctcctagccatgaagtgcacacgtacatgtgcacatttgcacaaacacactcaggcataccatccggcttgggtgtcacaaagaaaggctgccctgacccctgctttcaagtctggaataggtctctccaaacacatcccaaaggaccatggaaacacccatgaccatccccacccccatgagaactcttatcacactctgaatggcttttcttgggtggatcttctactggatcaaccacacatctgagcagggtgaaccctaaggctgctcactgttttatcaccagcatctagaatgttgcctggttgtggaagtaccttaatacttcttaataataggaagatgtgttatatccatttttaagcaagataattccaatgagttaagtattctgccaaagtcaaatttggttaagtagcctttaactacttgccaaggaataaatagattcagccataattttcagatatatggacatgactcttttatgatttcaaaaattttataagaaagctcgagtgaattgtgtttctttgatttcaactgcagttaaacatatatatgtgagtatatacatatatatgtattcttatttgagcaattattaaatttctgtataccagctgctatcttaggcagaggggacaagaattatagataaaactttgaccttctccatgggctcagagtagagtaagttaggagagaataacactacactctagtgtaacaagtgcacagagaggcaagaaaacagcatcatgacatctcaggagaagaagggctcaggagaagaagctgcctggaaaggatggagaagagttttagagaaagtgacgttataaaattatcatgaaggataagtaaaatgctgcaactggagaagagtctacagtgtgcaacatgtgtaaatgtgaagatgactgagggagccagtttgtcaggaaattgcaagcacttcattatgactgagtaacagaaacaaggaagatgaggaatgatcaatggattttataaaaagctagcgtaggagagatcacagagagctttgtactaccaagtccaccttttcttgcccaccctgccctggaatctacatggttatagcaatatcagtgatgtttgtgtgatgtgagcctgctttcaaaccaccatggaatgcctcaaaaattggcatatatccattcacctttttcctggaaactcagaaaaagacatagagggccatctgtcagcctagactattgtggttactacggtctttggtatcaggacattctagactgaaatcctgaccctgtcgtgtagtttttagcaagggatttgaccactaacagtctgagagttgatgcatgtataaggtgaggataatatgtgtcatacttcacaggattgttgttgtgtaaagtgcctcatagaggaaacataacaagaatttaaaactttcaacaatataaatgctatgggccatgtgccatttttcttcactaaactctatgataaagaaattattaatctcacaatttttgaaattgatgcttgtttattataggaaattcaggaactacaataaagtttaataaaaataagataaaataatcaagattttttgctatcaagttaatcattttagatttctttccagtctgtttctctacaaatacacatacacatacacacaaagagcatatcatttagagttctgggaaagaaacagaagaaacacgtagcttgtaatcccactattttaatatgagaaaacttagatgcagtgagttgaagtaatttgcccaaggttacatacatagcacataagtgatagatctgggttttgaaactaggcagtcaactttagaatctactctgttaaatactgttacatgatgttagttgttgttttattttgtgggggttttttttggctctttttaaaaatcattattttaagcaagataatggcaagattagaactatttttggtaatggctttctgactgcagtgtggagaatgtgttggggatatgagatatggagagcaatagggcaacactggaagcaggggaattcctgaattagccaagttgaaaagagatgacagtttcaattaagaagattttgatggaataatgttgacatgaagaattctaagaggacttaggagatacagattgtagaatttagtaagtggttgccgggaaggagtgatgaagacaggaaataagaattactctatgttcctagttggggatactaatcagtggcacatttacctagaaggggaaaacaagaaaaacagcttcaagagagaagacggtgtctgcttcttaacatatgaagtttgaaacatctatgaaatattcacttgctatcattcagtggtattgtatatatcataaattcatcttaaaaataggaacttggtctgggcaggcatataatgcttccattggcattttgctgtgcccttcatttgaacttctttgtagtattaggaaatgaagaaaatcaacaaaaaacaatgaaataaaaatagggtgatagtacaaaagaaatgagttagtaggtgggcagccatggagataaatatagacatgagaagagcttacagacagaatgtacattcttttcattagtgaaggaaaagcagtaatatttttagaaatagtaatatttaccaaattgagcctagactaatttctatgatacgatcacaggaaaaaaaaaagccaaagcttttatcttaagcaaaaacacaaacactttcttaaaacactaactttattcatttggatgaagtatacttatagattgctttagatacatttttgtgtgcttttggagttagcataatataatggaaagtcaattaatagtgaaaactcattttattttatcttgcacgtatatttaaataggataaaataaaattaaagttaatataaaaatgtatattcctggaagacactaatttttgaataagataatttttatattatgaagcatacaatcaaataatttccattttattttagggagtggggtaatttggatctcagatgattatatgttgtacattttaaatacaagcttcaagtgctgtgttctctaattccaagtgcaaatacaattagcaattatgagttaaacttaattatttggatatacttgattacatagcttggtgtagtagtatttccacacagttggttatgcttgaacttatttttttattcctatttaagcaatcataaaaatttttttagaaaaaagttaactcaagatggattaaagacttaaacgtaagaccaaaaaccctaaaaaccctagaagaaaacctaggcaatacctttcaggacataggcatgggcaaagatttcatgactaaaacaccaaaagcaatggcaacagaagccaagattgactaatgggatctaattaaactaaacagcttctgcacagcaaaagaaactatcatcagagtgaacaggcaacctagagaatgggagaaaatttttgcaatctatccatctgaaaaagggctaatatccagaatctacaaggagcttaaccaaatttacaagaagaaaaaaccctatcaaaaagtgggtgaaggatatgaacagacatttctcaaaagaagacatttttgtggccaacaaacatatgaaaaaaagctcatcatcactggtcattagagaaatgcaaatcaaaaccacaatgagataccatctcacaccaattagaatagcaatcattaaaaagtcaggaaacaacagatgctggagaggatgtggagaaatagcaatgcttttacactgttggtaggagtgtaaattagttcaaccattgtggaagacagtgtggtgattcctcaaggatctagaaccagaaataccatttgacccagtaatcccgttactgggtatatacccaaaggattataaatcattctactataaagacacatgcacacgtatgtttattgcagaactgttcacaatagcaaagacagaatcaacccaaatgcccatcaataatagactggataaagaaaatgtggcacatataaactatggaatgctatgcagccataaaaaaaaggatgagttcatgtcctttgcagggtcatagatgaagctggaaaccatcattctcagcaaactaacacaagaacagaaaaccaaacaccgcatgttctcagtcataagtgggagttgaacgatgagaacacatggacacagagggggcacatcacacactggggcctgtcagggggtgagggagtaggagagggatagcattgggagaaactcctaaggtagatgacggcttgatgggtgcagcaaaccaccatggcacatgtatacctacgtaacatacctgcatgttctgcacatgtatcccataacttaaagtataataaaaaaaagaaaagaaaattatttcttgggttctgattaaataatagtgaatatttacaaatatgtttataggactaattctcaagttttaaaacctttaaaatatatgccaacacggaaagacaaaaatcaaattttgaatctgtagcaatcacacaattcatgtttctgtagatagtgaaataaatccacactagatctaaaaatgtagaaggagcaagtcttatactaaacctcaataatatttgcattttgggggggcggggaaatgtgaaggaagaataattctggtgatagtcaaacactgccattttttaatttacatttttctaaatttaagcatattggcatgcacatttttggtaggtactgccctcctgccccctacagcctttccttgttcttggctatcttcctttctatgtggtgaagtgggaaggatagttcttgtatcatctctctgaaacacttgaaaattttgaccattccttttttcagggcaaaaataaaaattattttgctttggcttctgcactgtcattctatctgtgttacctccttctttttggccatttattcccattgtcatactcttaaactcctttttcttttcctatttcttaactcatgatgttgttcaagattttattcccagtcttgttttctcattgtttacctcgttctccctaaaacctttcatttgactcgtgtttctgtacctgtatgctgtagactcaccaatctacattttcagttgtttgtactgacctccatattcacagttccagccatcactgatcatctttatttgaatgtctcataggtacatctaacgcaacataacaaaagccaaactcagtatctttgcccgaaatttgctttttactcctgaatttccctctttattgggttgcccacatcagatccctagtgatcattctagattctttcctctctctcaccctctattttcagttgatcatttagacttcccatttttatctcacatttctcaaatttactcctagcttctatccctgtcttagttaatatcatttagtgctgaaacaacgccctgcctgctactctatttaaatgtgtctacctgacgtagagaaaagggtctttttttgaaatgatagtctcatgaggtcattcccaagcttaaagctgttcatagtctccccagttcagagaaaaacgaattgttcctcggcatgacacatacagtgtccatcattgacactctcatgcctctctgattttaaatttctggtattccttctcttaatattgtgctgcagctttccttgaataattatagctctctcttaccaagcatgctatgctgtctcaatctctttgctgtgcacaagttgtcctctctgcctgatgtgtctttcccatttggtggcctattcatcacctgtaagatgtaccttaaaatagaatatcatttctaaatatttataaattatttctaaatattctaatatttagaatattatttcttgatgcaagagttactttagtagataaaatagttcatcttcatttctgtagtaagtcttatttttagcatcctcacataagtaatttagcaggagtgatgctgtcctggtcatggaagctctaaatatcttacaatttatttacctatttattcatttactgatttgtttgtttgttttattactttatttactccacaagtaattatcaagtatctagtatgtgtcagcactgttctaggtaccggagatatataagtaaacaaaatagataaaaattctttgccttatggagcttacattctaatgtaaggtgataaacaataacaaaataaatatgtgtacacaatagtatcaaacgtgataggtgttatgaagagaaataaagcaggagagatgtgtagggagtacatgggaagaaatattgcagtattaagaagggttgccagaaaataccttatttagaaaatggcatttgaactaagacttgaataaactaagcaattatgccatatctaaagaaaagtgtttcagaaaaagcaaggagaaaaaaatataaccacggggaaaatagattaagaattttgagctaaaggagccacgttttagttttgatgatgagttttgggaaaatctaaaaaccaaagaagactattgtgacatctgtcatttgttgtgtgtgtgtatgtagatctgtagatatatgatgacatatgtagatgtttcattactgttttagtaacaataatgtcatttcttttaaaatagctttgtgtaagcctgggcaacatagtgaaacctagtctctacagaaaaaaaaaaattaattagctaggtgtggtggcactcacctgtaaccccagctactcaggaggctgaggtgagatgattgcttgagcccaggaagttgaagctacagtgaaccatgattgcaccaccctactccagcctgagcaacaaagtcagattctgtttcaaacaaatacacaaacaaaaaatagttcagtgtaaggacttgtccacgtaaaagttcgtttttcttgttgttaagagggagtctcgctctgtcgccaggctggaatgcagtggcgcaatctcggctcactgcaacccccaccttccggattcaagctattctgcctcagcctcctgagtagctgagactacaggcacgtgccaccatgcccggctaattttagtattttttagtagagatgggatttcaccatgttggtcgggtcgcaaactcctgatatcaagtgatctgccctcctcggcctcccaaaatgctgggattacaggcgtgagccaccaagcacagccagataactgattttataagacagttatgttgacctagtgtatcacatgtatcaaacctaggtttaaatttaatccagataggatctagactttttagaggtatttctgatacagaatcacttatttttagttaagtattcaataaatgaccatgttagacttatttctcctctttatagttcagtgtaaggacttgtccacataaaaattgagtgccactgcaccccagtctgggcgagagagcgacactccatctcaatacatgcatacatacatacatacatacatacatacacacagttttctgttttctgggacctaatatttgctactcaacattctataaactttactttgttttaaatatatagtatatatggtatattcagagataacattatctaagcatctaactttttcagaatgcaagaaaataattaaaactcaaattctagacaggctaattgtccattccagagttcttccaagttagaagtggaacagtatccactaggatagtatttcagtgactcaaaaaggaaccaaacaaataatttttttgcatgaatgcattaaatgcgtactaataatatcttgttacaaacagaattctgactaacaaaccctaatgaaaatacaaagcctaacatatacctcttcttatccccaaagggattattttactattcataaatacttgtatttttgtaagcccagtaatctttcttttgagaaaacaaaacttattgtgtaacatatcttacagttataactcaaagcacttgtttttaaatttaattcataacacagaataaaatatctgggctactgttaaaactaaagattcctaggcaaatctctatgattcagtaactctagagttatattcaggggcttgcatttggaaacatagctaattgtagtaggcattcctcacatttaccaatatctctggttatcttcacttctaaacctcaaaaagttgcagtttccaaatccttgctgtggccaagaggattgctttagctgatgaaatgtgataagtggcattgttcacttccaggtggatgcatttaattgccttgctcttcctctccaactcattcatttcccaacatagcaattgtgctcaagttcaaagcatcctaaaataccgccaaaatatcaaagattgctaacctggagaattatctggacctacagcagacctggcttttatgagatatgaaatcttgttctgttaaatcactgtgatttgggaagggggatgatttttactatagtataacccagtcaagttgtcgttgaatttccatgtgtattaaaaacattaggaaggcttgataaaacactgcttgctagactgactcccagtttctgattttataggtatagttgtggcctaataatttctttttctaataagtttctgggtaatcgtgatgccattagtttagtaactccacttgagaatcactgatctagccaatcttgaccaatatacaaattttcatattttgaaacaaattgacattaagtcaaacttatcaatatgataaacaaaggcatcattttgtatgtaaaacaaatttaaaatgtttaaacaagcataattttttagtgatttaacactgacaaaattattaatcacttcttaaaaacacttaattgtctgaacttcaacactgagtagcaattattctgctaaatattcttgtccttaagagtattcaaaatggttttgaattagctttaatatgaaggaagaacagtcccctgtaaatacagtaaaaattgtgaagtataaattgagatttaaaacaatctgatattactagaatgttttataatatccatttcatataaatttaaaaatagttttactttttaacttttaaaaaatgtacaaaaagtactaattaattacatgtgcaatgattctgacttgtcatttaagtatttttttcaaattccccattccactctcacaatgaactttttatccaattgaaataattgagttggcattaaagaaagaaaattaagtcagctcttaaaatcttaacactaacttgttaattaccctattaataacacaatgaaaaatgacaagctgtaattccttttccaaaaatatggctgaaggtcagagagctgtcttgctggcatattgagagaccgaaaattacaaatgatgagcttttttttcttttaaatatcatcagatgccattagaaattcagcgaagagactagatcaatatttaaaatataattttaaacataattttcctattattaaagaaaacaactgctatatattaggaaataacctagcaaagatacttgtatttgtgtgttaagaagacaaatctaaagggtttccaaacattgtccaggtctgagcttttacactattgaaaaaggattccgtgtgcttttagcctacagcaaagatcaaaaagcattcacagagcctactggcaaaccagagataaatagaatggttttctctgccattaaacaataattcttgaaaatgacttttttcttttatgtggggtagagtaaatccaaattatgcaggacaaagtttacatgcacagtaagtgatctattgtggtattgtttgcatttttcttggtacagtttaatttattgttgtaactgcttcgctatttaggagaatagaattggttaccaaagacattgtaaaactgttctataatactgtagtactcatttaatatacatatataaatagttttactttttaatttaacttttaaagaattttgcaaaataaaacagaattctgtttcagagtagagacacttaaacatttgtagttttcttagaacatgtataacagtaccataatcttgtattcagatttttaaaatttgtaattgtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcgatgttgctgtgttgtaaagtgtcgaaattttctttgtttttaaggctcaattatattccattgtatgtatgtgtcacatattattcattcattcatcaaatacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcctaccaacagtgcacaagagttctaacttatccgtatcctcactaacatatatatatattttaattgtactcatgttgatgggtgtaaggtgatatctaactgtggttttgatttgcatttccctcatgattaatgatgttaaacacatttctatattcttattgatcatttgaatattttatttggggaaatgtttaagttgtatgctgatttttttattttagctgtttgattcattggttgttgagtttcagtaattctttctatattctggatattaactgactatcagatatattatttgcaaatgttttcttctattccatgggttgctttttcacgttgttggttgtgtcctttgatgcaaatttttaaatttcataatccagtttatttttactttttttaaacctatacttttgctgtcatattcaataaatcattgccaaatctaatgtcatgaagattttcccctatgtttttttctaagggttgtatagttttagatcttacatttaggttttttatgttttttgaattaattttttttctatcttgaagagtaagagtccaactttattcttttgtatgtggatatccagtttccctatctctgtttattgaaaagactattcttttgtcatttattgaccacatatgttagagtttattgttgaaaatgaaaattattttaccacatatgtgagagtttatttctgagctctctattttattccattggtttatatgtctgcctttgtgccagtatcatactgttttaactagctttgtaataagtttgaaatcaggaactatgagatctccaactttgttcttttttaagattgttttggctagtcaggatttcttgagattctatatgaagttttagctgagtttttctgtttctgcaaaaaattttattggaattttgatagagagtacattaaatctatagatcactttgagtaatgtactcatatttttaaaaccaaggaaatttgagttatactaaaatatactttataaataaaacaacatttatttgtcaatttattagtctatttagtagccaatcaactaacatagattctttctatagcagtacatttgctgcttcagttagggtccatcacattctttaatttgagctcacttccttatttgtctgaaaattattttttctttataaactttatatactgatgacatatacaactatataaagtaatatcttatcaagcacttccttggccaaagaagaaccaaatgtgaataagatgttttgattctccaaatacttaaacactagtgttacaaataaattacagtacagtatgataaatgctaaaagagagttatataaaagtgttatggcaaactggaagttgaaatcaaggagatccagttggttggagaactaaacagagatgacatttaaactgggtctcaagtaatgttaagagtaggtaagataggaaatgcaagtgtacagagctgtgaaatggtatggtgaactggtagcatgatgaaacatctactgaggttgatacaccagacatcatctagagatgcccaagaataaagacaaatggatcaaaagagatcatgaagggactggcaagactgaaaatcagagcatataaccatataagactaaagtaggttagtcaccagcagccctgtagaagaggctgtggctggaatttgaaattattaaatatcactggacaggttggaggcataaataggttccaaagaacagtcttgatttaggcctcataatgctgcttaccaagaatcaattaactttttaggaaaaagtgatataatgaatttttgagtatggaatttttaattcatataatgtatttagaacattaaaaggttattaagttttgtagttattggtgctatttaccaaatatatctagctctggtctcaggcatagaacagaattgcattttctcaccctctttgaggttaggcaaagccatgtgattttcttttgccagtgaaatgtgagcaaagtactgaaatatttcttggtgactgtttcaaaagtcagttatcagtttgtcacattttcttctccatgctatagtaatgatgagaacatgattcttgatggaggtactggagtaactgtaaggtgcaaagccaccctaccaatccatgctagacaaacaataggaacggcaataaacttgcctgttgtttagcccctgagacatgtaaacataacttaccctatcctgactgtacaacaagtaagacataataatggctgtagaaagccttgataacagaataagaagaaaaaaaaaaaaactaaaatcaaccataatcttacccaaatgagtcattgtaactatttttatatttacctcttaaactatagtgttacaaagaagcttaattcatcatgtcaattatttacttaattgtgacagatgtttactctgctaaaggtatatgctgttgctctctctctcaggagattagcttccctgtcagtagctattgtgttataactagccatcatcaatttttctcttaagtgggaaactacaatacataacaaggttgttttgaatctcatatgagacaaggtatataaaataagtggcacatagtacgttaaacaataaagatgggagaggccgtttgtctttctaaaggtttgcttatcaaaattttaaaatacttgataccttcaaaatataaaccatttttgttcaacaaaactaaagcataatgtaataattctccatctcccttaagcaagtgtatgccatttgtcattttctttaaaaataaatgaacttgttcaattagttgaaaattttcttttatagatctgattttacaagttgatgggtttttattgcagcattatgtaaaaaagcttgaactttattgctcttgattagtccttatccttctaagaattttaatggtaatagaatattttaagatgcatcagtgcacatttatgttgaatgttagtatcctttctgctctttactgactaacactacagttaataataaaaatttatctttatttttgaaggcttattatgcatatatgatatttatacatttttggtgataaattctatcgccacctagtgctttggacaacattttatatttctgccatttctttttgcattacattaagatgtgtaaactgtgactgcccattcttctcataagacttttctctccccagtaagcttacttttctctccccagtaagctgttccacaagggcagagaatgcgttttctttagaactgtgtcctcacctcctggatcagggcatggcttgtagtagatgcttaatgcacatttggggagtgaactaatagataaatactatacagttcagagtccaataactatattctgacacaactacatcccctacttggattttaaaagagaaagtttttgtatcttcttgatgatctaattataatgctgtgcatctagtttagccaggacaagatttacatatgttgctgaatttagtaaattcttacttcctggacttcagataaggtaaaaagtaagcataattacaaagggcaggaaaaacccttagttatgaaaatatgtattatcttgactatggtaattatatcataatgtcaaagttaatcaaattttacactttaagtacatatattttagtttactttaattagaataaaattgaaaacaaaagccaaaaaagtaagaataacatattaaattgctttatattacaacagcaatatttctgtaaatattcttcctctacatttcaaaatttgcaaaagatatcaccacaggcaattgggcattacttttgagattctttgtcagtggaatacattaaatctcccgcctgatagagaaattaaaactgccacatttctgtctctgctagcatcatcttgaaatgttcatccctcaaacaggaatagatggaaaggagaggaaaggagagatgaacagagtttggagaggaaattacctcattactatgagcacagagaagagagacaagaaagagatataaaacatgagaggtaaacataataatcatcatgacaacaacagctattgaaagctcgctgcatgccagtaacagtctaaacacttagcatgcatttctcgtttttctgttttcatggcaactctgtttagtctccctatataaaaaaatgtaaaatctgagtcttaaagatgttatgaaacttttctgagggaaagtacaagtgtcagaataaggatttaaacccaaaatgttgaatctaatagtcaggttcttcactgaacgctatacctgttcataacagacacaaaatgtaaaaaacaaagaggtaaaacagaaagaaacaagcttctatgtgtattggtagatgaggagagactttgcagctgatgctaaacaagaggctagggtccacagctatctacacatctcctcaagacagagctccactgtagacagttaactccaggtagacagaagttaagacatgtggaaaacattaaatagaagcaattgtttgctataatctttgccacttttgcactgtatgcatttttgaagatccaaggccttctcccaggctatagaagtgcactttaagccaatattttgttttatgagatataagaaatcacagccatataaataaggcacaagcagagatgagtaaatggtatatagtgtctccagttttagaaaggatgcagattatatctgaaccagcataatgtcactacaagaaggatgcataatgtcataaaaatgtacttcatacgactcagttatttgtattttttatttatttgtttttaactaaagatgaatagcctctgccatattttaaaagggcaggcaatataaagttcaatattagaaaatgtacctaaatgactggaaaacacatcttatgaactagtatattaatcattcagtgtaggaagcagaaggcaacattacatatcactgtgatgtgctaagtgctagtctcaaatattcatggcttaggcaagagtttatcaaccttggtgctgtttagttgaagtcatggggggctattttttgtaaaatgtttaccagcatccctaacctttacccagtagatgttagtagtagttctcatccccagttgtgacaattaaaaatatctccagactttttgccaaatgtcccctagaggcaacatcacccctgatggatcactggcttcatttgagtatatttctaatcattatttttcattaaataattatgtttcagacttgcagtaaagatatgctgtaactttagatatgatttagaagtctatatcttagaaactactataaatagactcagtacaattggaagtggaattggactaccgatgattatattcattcacataaccatttgttaaatacacactaaatgcctgtcactgttccaggttctaggaatacaaaaataaaggacacatttgagatctgcattacaccaaaagtgatataaactgtttattgatccagattctccaagatctacttttgtattctattaatttaatcatcagaaaccatgaattgttaggccatattaccttacatctatgtagaaatatttttcctaagttatcatggtttctctgggaaatgaatataaaaatttcctttgaaatattttttagttttttttaaagtgatgagccaacataccatgcaccatgctattcactgtcttcaatccaaataacaatttacatgataaactaaagattgaattcaaagcataaagattgtttatcaacccttgatttcatttatttatcatttgagataacaattctactttttaaattatttatatcgttagagaattagagaagaaactatatgtattagtctgttctcatactgctaataaaaagatacctgagattgggtaatttataaaggaaagaggtttaatggactcacagttccacttggctggggaggcctcacaaacatggtggaagataaaggaaagacatgtcttacatggtggcaggcaagaaagcttgtgcaagggaattcctatttataaaaccatctgttcttgtgagacttattcactaccacaagaacagtatgggggaaactgccccatgactcaattatcttcacttggccacacccttgacacgtggagattattacaattcaaggtgagaatatgggtggggacacagccaaaccatatcactaaatgttctgagtacttaccagaatcattctctccggaagcttccttctaactgtgctctctcctctcttcctttcaagaaggtagtttaggtcctgggataaaaacaaaagacaaacaagtgacataatactagctccagaaactgtgatagcatattttatttccatcacctcaatcccctcaggaagtacagaaaactcacagagagcattgaagaagtaaagaagttatgcaacgtgcccaaggtcacacagtgcttggtacccatgtttgactcaatcttaagtccatgcttttgtcatgccactgcttttcctctggatcacgtgggttggagtaatattaaacatgtttaacaagtgatcttacagacagcaaccaacagctcgtacatcatagagatgtttactagctgataatcagctttcacccttctagaagacccagtctacatacaagtacaagccacatttaatttcctacctgtattctcataaattagtcgaactgagtcaccttcctaaactctggataccctccttataataatcttggagatttaagattatagcaaacaggtaaatgagtttataaaatgttcaaggcaccagcagtgttactgtgcttcagggtagagtcagggaaattagaccaggtgccagctaagagtaaagggagaaagcccagagtatgattctggatcactgacaactgatgctgtgggctgaggaagggaaaggtgcagaagggtgaaagtgggtggagtttggtaccaagtctgagcagaaactacacattaggactgcaaaggagatcagtaaaagccagatgatccctttttccatctctagatcttctagaagtaaatttcacacagttaaggctcattaagtgctcctagacaagctctttgcaacagggcttcctggggagtccagacaaattactgtttcctttgaccaaagcagcctgaaagcaggttggacctctttattagaatgaacttaggtacttaaattctcctttccctttcagagcacataggatttttctgaccataactaaagtgcaaaggtttaaaatactaataattccaagaaaggaaacattggaaaccaattagtaaggatatccatctaaatgaccagaaagatattttccactgtttggctagaaggagaggaaaaaggcgtgctgaccacttggtttctgaagcaccagaggggtcaccaatgtgaggaaaaggataagagaggggaatcttagagcaaagatcaactttaaccacctccttttcagtttaagtctccaaattcccctgtcaaagaatactcagtcgacaaagagaagctgtaccaaaaactgtttcatccataatcagctgtgcccagaaacagctgatgcagggagtgaggtgcattagcagaaagtcaggtcaagccccaagcaaaagtgatggttggtgagcccagggtctctttgaggagactccagcctgaatctcccattatctgccctccctctttgctccattagaaataatcactcctaagtggcccattatcaatgccagcatgattttttcacatttgctaaaagcttttccctttttcttttgtttctaaggaactattttaattccctctcccctttattttgcagttaactgacttgaaaaatatctgatttgaaatggggcttacagaccaatttcttctttccttcagtacatcccacgacccattccccaccccctagcacctagtaacagccatcgcatatgcattaaacaaaagacccattagtggagcattgttttgcacttctgcagacaaagaagaaagagacctccagttagaatgaactctttttgtatttctttctttttctttttttttttttttttttggcaacaaatagctttcttttaaattcagaaatgaaatggaattgagaccctaaattgctctcatctaaaatgtttcactctcatcttcactttcctagattatgatcaattttccccagaatgaataattcaaattgagcccagtcttctgaatccttagaaaaaacaatgccttagcattttgggtctattctactcacttatcacttggcacattttgtctggtactggcagatattctttttgtaacatataatttatttttccaaatggactacaagcttctgaagattaaagaccatttcattcattcattcattcattcaacaaatgtatttgagctcttaccatgtgttagacatgtgctaatcacttgcaatacagccaagaactaatcagacaaaaatccctgcctccctggagtttatattctagtggagggagacagagaataagaaatcagtgtcataaatatgtaaattgtagagtatgttagaaggcgataagtgcaacagaaaaaaatagagcaatgcaagaggaatctgaagcttaagggagggctacaattttaaatagggtggtcatgggggatgagagagtaagccatgtggataaacagaagaacattccaggcaaaggatatacattaaagtgagaacttaaaaaatggagttgccatcagctgactgggaaggctgtgtttggatatgttaagttttgggtgcctactaacgtctcactggagatctgatggagtaggcagttggatataggtgtctgaagatccagtagggtctgggatgaactattcatttgagagtagttttaaaaacatgaaattggatgagatcatcacagaagtgagtataaacaaagaagactcggagatgacaggaaatgatctctaagataagaagaaaactaaaaatgtggggtaccctgaaagtcaagtgaagaaatcatgacaaagaagcagagaataatactgctggtatgtcatgtaaatgaaggctgaaaattggctgtggaatttagcaatctggaggtcattggcaatcttgccaagaaaagtttccgtggagtgatggaggttaaaacttgattagagtgagcttaagtgagaatgcaaggtgcagtccaccagatgtttgtgttccccctaaattcatattgaaactctcatcccagtgttattgcacttagagatggggcctttgggaagtaattaggtcatgaaggtggagccctcatgaatggaattagtgtccttaccataagaggccagagagctagctcactctccttctatctgtgaggatacaaaaaggtggccctccacaactaagaagaagattctcaatagaacctgatgatacgggcatcctgacttcaaactttcagcctctagaactgtaggaaatatctgttgtgtataagccatccagtctatggtactttgttataccagcctgaactaattaaggcgggggcaaggatttgatgattatatatacagacaacaatttttagaatattttctacaaagaaaagcagagaaatgaagtgatagatggcaggggaattggtgtcaagataaaacttaattaaaattaaataaataacagtatgtttatattctgctgggaataaatcaggagagaaggaagacttaataatgcagtattgagagaattgtgaccaactgtaacaatacaaaggaaatgttattttttatagcaggtagcaaagcggtttcctcaaaggagagaccctatttgtgatttctttcataagcctgcttagtggataggcctccaggacttctttgtcagctggtgcttaagcttgaggagttgaaatgcgtttgtgtttgccataggaaagaggaagagaactggacaaggcatgaggggaagaagactacatatcacgtagccaagaagacagatgtggggagtgcattgtgacttgtgatataaaccttctcctctgtctctctatcttttcaccaaaatctacacttgtagttttgctaatggaaaatgtcaagacgtgctgaaagttgccttgaggttgtaaacagatttaaagagtgaaagtagagcctgcccatggaaggacaagtcatgggggttacagagtggactctctctgacagacttctgttattattgcttgccccaggcagctctcacttattttgtatcaaattatcccctcagaacgtcatacctgtctcattctacaaagtcttccctggcaacacacactctagactcctaacttacttagctacctggtcttgacctttggagctgtcatcctatgcctatataatggcccagcctctgcttactcctcacccccaccctgcgccctcactccccaccacctgatctctcactaccatgtttcctccttgatcaatgccaggcaaagtgaactatttgcagttccccaaactcgtcatgctgtctcattactaacgtctttgtgcattaagttccctctgcctgagtatttttctactctttcaagagtcaagccctcctctttgctgatttaactcagagtcctttaaaattttgtctaaaacatctttattttctttctttcttttttttttcctcacttgttgcccaggctggagtacagtggcactatctcagctcactgaaatctccacttcctaggttcaagcaattctgcctcagcctcctgagtagctgggattacagttgcctgccaccacgcctggctaaatttttgtagttttagtagagatggggtttcactatgtcggccaggctggtctcaaacacctgacctcaggtgaaccacctgcctcggcctttcaaagagctaggattgcaggcatgagccactgcacctggcactttaaatatctttctagtggaaaattataccggcttatgcacttctctcatggtaatacttttcataatgtaccacaactgatggtttattttctgtctcctcgtttaaactgtgaggtctctatcatcctggtattctttgtacctaggatagcatctacttcacagtagctgcctaataaatatttgctgaaaactgaataaacatctaatgtcaaaagttgtgaataccaggtaacttagcataagccttgaccccatatgagtggggcttagagttcatctgctgctctaaaatcaaggtcattgtatctagtagtgaccccctggtactcacaactatataaagatacaactgggatcgtgatgtttgttcctattttattttactttttttccccagtcctgtattagaactagaagctgattggtcctgaatcacaacgaatttgactggagtcctatccttcagattagttcttctgatgtctgcttctatacttccagctaatagagcctttcccaaggtcaggtagttggcctacattctctagagcctgaatggctaggagactgaggttgcacagcatctgctgctatttgactcttttctccctactcctctccccattctgtaatatgttcaataccagcaccagtctgtaataaggcaaattttatgactggatttaggatcccatttgggaagaagtattactgtactattgcattggttttctatctcaactaggctacttccaacttacacttcacccgtgtcccacccacccaagatgtcaggtacatctcacagctgagacctgggttattgttccactttaacctctatgccagatgtctacctgctgaaccattttgcatgctcaacccactctcctatccacctctgctctgaaatctttcccaattcccactcttcatcttgcatgtactactctcagctcttccttgtgttaacaacttagtgtcttttactgaaattaaaaattttgtcaggaagtttgcagatgacatatatatggggattgagtgtcctggtacaactaactttgacctttgaatactataaaactatagctgtggaactttgtatgacaaatcagtgattcttctagttctggttcccaaatgactaataaaaagttaacaattttccacatttctctgattttaaggtactcatttaatactcattcctatccctaaagctcaagttcataggtttcctccaactgtctaggaagattaaatcacatgtgtaaatgtgataagagtattttaggtttgaacacatggattgcagaatttgtatgctggccagaatttctggtggagtaagaattttttgtagaaatttattccacccatcatgtaaatggctaaattcttcttaaggcagatcattacctagatattttgacagatttggcaaaaagaaacaggacagcccaacctaattcaattaatcttaccacctattcttaagaacaattactcacaagaaaaatacagctgcaccaaagaataaaatccatacctgccacttattaaagtaattttcaatttgcttaagtctctgtgcctcattttcctgtacgaagaaaaaaaaccacttcctcgtagtaagttgtcataaatattatcaaatatcattctcaaaaatcctgagttgcattaaagcaaaaataaatcatgaatggtatatttttattttctttttaaaatgtagaataaaacacaatggaccatagacatgtacttagggtaccaaccagtggacatgacaagataacataatgttgatagggaataggagtagggaacaatgtataactatctaaatgtgcatgggaaggggtgctaactagccctagtttttaggagttccctacagaattacaaggaccactgcttaatatcagttatgagagaggctgtggtatgcatcagcttattgtttgggaagagcttagtatgagatggacccttctctcatcttattaggactgaaaaattaagttagttgatttacgggaaagtggtaaagatttgaaaagtgatagatatgataaatggcaggctgggcatggtggctcatgcccaaaatcccagcactttgggaggccaaggtgggtggatcacttgaggtcaggagtttgagaccagcttggccaaaatggggagaccccatctctactaaaaatatgaaaattagctgggtgtggtggcaggtgctcataatcccagctacttgggaggctgaggcaggagaatcgcttgaacctgggaggcagaggttgcagtgagctgagattgcaccattgtactccagcctgggtaacaagagagagactccatccaaaaaaaaaaaaaagaaaaaagaaatgataaatgacaataagaaaggcataagagaaaaatattcaagacaatagcaatgaagaaaatatttaaatgttctaaaaatattttggaataggtgtttagaaattaaaaaaaatgatttatgcttaaatacaaggctagacttttcatttcagcaaataggataattctactgcccaaacatataggtagataatattcaacctttaccacaaatttagtagccattgtcattgttaagggcaacagtaaagtattttggaaacatttggaatttaaatcgccctttgatagttaaactgtgaaattaacacataatgaatatctatgaaaagttgcaaagctaccttaaaaaacacagaaagcttcccagttaaggctgtattacatctttactgaaggtaccaatataaccaaagaaagaagaaagaaaatgtccatcagaaagaggacttaagtcagacatttaagtttcttaaaagcagaggcttgcagaggaaaccaaacacaacacttctccaaaaattgttaacgggaaatagatccttaacatttactaccaataaggccagttatattgcactctggaggcaaagactaagtactatatttggagaaagacttccagggtttaaatctggctttgccatttaatagccatgggcctttcaaaataatatcccagatatcagtgttttaacttcatctgcaggtggggctgacaatatttcttcttcatagagttcatgtggataaaatacacactatcaataaatgttatctatgattattacatttactgagtgatattgataggctttgtgtcctcacccaaatctcatcttgaattgtaatctccttaattctcatgtgtctgggcagagacctggtggaaggggtactttgccttatggtgttcttgtgatagtgagttctcacaagatctgatatttttacaaggggctcttccccctttgctcctcacacttctctgtcctgccgccatgtaagatgtgcctcttttccttccaacatgattgtaagtttcctgaggcctcctcagccatggggaacttaaagtcaattaaacctctttcctttataaattacgcagtcttgggtggtatctttatagcagtgtgagaacagactgatacattgagccaattccctttgccctgatttcaaattaacattaagcaaccttcagattatgatatggtttcttgtataactcaagaaagcaatggccaatttgagtattggcacgcctggaacaggttttgtatttttattataaattaatggattgaatttctcctgttatattccagtcttatgatcttgattattatgagtctattatgttagcaatgtggcatatgtttgatagcaacccaaaggtcttttgagctaatgtcaagattcaaaaattcaacacaggttgcctcagttaagggtgtaaatttttttttcataagaaattctatttccagggaaataaataatagagaatgcatatagatacatggtagggcatcagtcaaatctaggatgagggggagtatagagagaattatccctgttcttctttcacttatgctgatagaggctaaaatgcaagataatctcctttctattagtaacttggactatttcaatataccctagtttaccaacccatccttagatatgcaaccaaagtgatctcttttttaaaatttattaatttatttattttattatactttaagttctgggatacatgtgcagaatatgtaggtttgttaaataggtatacacaagccatggtggtttgctgcatccatcaacccattgtctacatgaggtacttctcctaatactatccctcccctagtccctcacccccaacagaccctggtgtgtgatgttctccctctgtgtccatgtgttcttattgttcaactcccacttatgactaagaacatgcagtgtttggtattctgttcttgtgttagtttgctgagaatgatggtttccagcttcatccttgtcccagcaaagaacatgaactcatccttttttatggctgcatagtattccgtagtgtgtatgtgccacattctctttatccagtctatcattgatgggcatttgggttggttccaagtcttagctattgtgaatagtgccacaataaacatacgtgtgcatgtgtctttatagtagaatgatttataatcctttgggtatatactcagtagtgggattgctggatcaaatggtatttctgtttcttgatccttgaggaatcaccactctgtcttccaccaacagtgtaaaagcattgctatttcccacatcctctccagcatctgtcatttcctgactttttaatgatctccattctaactggcatgagatggtatctcactgtggttttgatttgcatttctctaatgaacagtgatgatgagctttttttcatatatttgttggctgcaaaaatatcttcttttgagaagtgtctgttcatatcctttgcccattttttgatgaggttgtttgctttttcctgcaaatttgtttaacttccttgtagattctggatattagccctttgtcagatagatagatagcaaaaattttctcccattctataggttgcctgttcactctgattatagtttctgtttctgggcagaagctgtttagtttaattagatcccatttgtcaattttggcttttgttgccattgcttttggtgttttagacatgaagtctttgctctgaatcatattgcctaggttttcttctaaggtttttatggttttaaatcttatgtttaagtctttaatccatcttgagttaattttgtataaagaataaggaagggatccagattcagttttctgcatatgaccagccagttttcccaacaccatttattaaatagggaatcctttccttactgcttgttttttgtcaggtttgtccagatagttgcttgcagatgtgtgatgttatttctgaggcctcgttctgttccattggtctgtatatctgttttggtaccagtaccgtgctcttttggttactgtagccttttagtatagtttgaagtcaggtagcagtatgccatcagctttgttctttttgcttacattttaatattgttatgtgtgaatttgatctcgtcattatgatgttagctggttattttgcccattagttgatgcactttcttcatagtgtcgatggtctttacaatttgttatgttcttgcagtagctggtactagtttttcctttccatatttagtgcttccttcaggagctcttgtaagacaggcctagtggtgacaaaatgtctcagcatttgcttgtctgtaaaggattttatttctcttttgcttatgaagcttagtttggctggatatgaaattctggatgaaaattcttttctttaagaatgctgaatattggcccccactctcttctggcttgtagggcttctgaagagagatacactgttagtctgatgggctttcctttgtgggtaaccagatctttctctctggctgcccttaacattttttccttcatttcaaccttggtgaatctgacgattatgtgtctttggggttgctcttctcgaagagtatctttgtggtgttctctgtgtttcctgaatttgaatgttggcctctcttgctaggttggggaagttctccttgataatatcctgaagaatattttccaacttggttccattctccccatcactttcagacacactaatcaaacataagtttggttttctcacattgttccatatttcttggaggctttgttcattccttttcattcttttttctctaatcttgtcttcacatttttttttattaagttgatcttcaatctctgatatcatttcttccacttgtttgattcagctattgatacttgtgtatgcttcatgaaattctcgtgctgtgtttttcagctccatcaggtcatttatgttcttttctaaactggttattctaattagcaattcctctaacctttttttaaggttcttagtttccttgcattgggttagaacatgctcctttagatcggaggagtttgttattacccaccttctgaagcctacttctgtcaattcatcaaactcattctcttccagttttattcccttgctggtgaggagttgtgatcctttgcgggagaagagacatcctggtatttggaattttcagcatttttgtgctggtttttccttatcttagatgatttatctacctttggtgtctgatgttggtgaccttctgatggagtttttgtgtggacctcctttttgtcaatgttgatgccattcctttctgtttgttagttttccttctaacagtcaggcccctctgctgcaggtcttctggagtttgctggaggtccactccagaccctttttgcttgggtgtcaccagtggaggctgcagaacagtaaagattgctgccagttcattcctctggaagcttcatcccagatgggcatctgccagatgccagctggagctctcctgtatgaggtgtctgttgaccgctgctgggaggtgtctcccagtcaggaggcatggggatcagggacccacttgaggaggcattctgttccttagcagagctcgaatgctatgctgggagatctgctgctctcttcagagccagcaggcaggaatgtttaagtctgctgaatctgtgcccacagctgccccttccctcaggtgctctgtctaggaagacagatgttttatctataagccctgactggggctgctgcctttctttcagagatgccctgctcagagaggaggaatctagaggggcgatctggccactgtggctttgctgagctgcagtgggctccagccagttcaaacttctcagcggctttgtttacactgtgaggggaaaattgcctactcaagcctcagtaatagcagacgctcctcctgcccccaagctcaagcatcccaggttgacttcagatggctgtgctagcagcaagaatttcaagccagtggatcttagcttgctgggctcggtgggggtgagatacgctgagctagaccacttggctccctgacttcagcccccttgccaggggagtgaacggttctgtcttgctggcattgcaggtgtcactgtggtaagaaaaaacactcctgcagctagctcagtgtctgctcaaatggctgcccagttttgtgcttgaaacccagggccctggtggtgtaggaacctgaggaatctcctggtctggtggttgtgaagactgtgggaaaagcatagtatcttggctggaatgcacttttcctcacagcacagtctctcatggcttcccttggctaggggagggagttccccaaccccttgcacttcccgtgtgaggcgatgccccaccatgatttggcttgccctccgtggactgcacccactgtctaactagtcccaatgagatgagctgggtacctcagttggaaatgcagtgccttctgcattgatctctctgggagctgcagaccggagctgttcctattcggccatcttcccagttaccaaagtgatcttataacaagaaaatttgtttatatcattcttaatttcttcagtgatttcacagtgggcagggtaagtatttacctaactcacagaatactccagcttcctcaccctcagaggtaaggcccaggcagtaatgttcatacattaaagtaaatctatgcccctggctgcagttgattataccaagggttaaaacagctgggccaattatattctttcttctagaaatttggaattgtgatgaagaaagattagtctcttccaattgctggactcagtagttgaatgatggctatgtcttctgtgtgaactgtgaagcagagaaagctggtctagttagaaagaaaataatgaaacagaaacactaagaagaacagaagtgaaagaaggtgacatcttcataggctcgcttctccttgtttctgtttctaaggacttactgaattgccacacttgagtttcaagaaactgcctagatttttctgtttaagtcaaattattttttagcttaatcctgaattatgttttaactgattgcaactatgaaactccttctcttggaaagtgcagtctaacatgatacccttcataagtgttttttaccagctactggtcagcctcaccttctactgtcacagcttctgcttgattccccatctctccaccaaacaccacagaagacattttaactttttatgttctcataccatggtgttttctatatgctattttctatttctacagtaatcacccatccttgtccacttgctaaatggttacccattctgaacacttctatcgtgctttggagattctcacattattgtacataagtcattgaagaaaaatgatttgcatatctgtctcaccaccaccaccctataatctcacaggtggtgaacatataccatttatattttttaatttcacttctgtattctcaattcaaaatacacaatatgtgctgtcatgtattcctgatacatttacatcttttaatcattcataagataacatgtatgttcaataagcacaactactaaagactttggggttgatgatattatttctgggacaagaagataaaataaaacctgagattctaaagagttacgttctacttggcattcccaccaggacataaaagttctgataattgttagtcatgagcccagcaacataaaacatcataagctctttcatcaatgtcaacgttaaatcatatttgatgtattaagtgccagtataaaaccaataacagcagcatcctgggacatagccagaataagagctgtgaaggatcatttgccgttcataactgcattgacttgagcacaagtggggattaaagaacagcaggctacctaatcagccgctgtctggagagctgaagttgggttatcacaagctgagagggcagtgagagcgacagtaagacaggcgtacatctgaacaggttgtcaggagacaaaagtgcctgtgaagtggccatcagaattgaacaatgaagtgtgttggtcccactgagggtgagtcagtcacaccgccaggatagcagatgatgaagtatggtgaagtaggagaagaaatatacaggagaagaaatatacaggatgcttctggattatgcttgttgtctttgtttaattattaagcaactacctctgtgtcttcttttaaaaagatgcccgtttggtgaaaaataagagtgactgattataaacaaccattaaatcaaaatattaccaaattctgcacacagaccaaagttacaataatcctgttaaagagtttctaaaacattgctgtgatgcatttctgggttgtgtttgtgtaggtgtctgtgtgcccagaatccctttgagggaatcttcgcagtccatgtagttcaggcgaggctgcttcagtcacccactgatgccattcggtaggcatctaacctaactgcaactctctactcccaccaaatcacaccagtctgggacagaggccttcctaggatactgacagaacttttgaggaaaatatctttttatgagtgtgaaattctgattgtcatctgtgttataaaatgggaaaaagggaaggagtaattaaggtaacagaggaaaagagaacagagaaacaaagaattccttgtttcaaccatgcctggagtttattctcagttatgggagacaatgagttacctttttgctcagtgtagtgtgaattgggcctgcacatattaccaagatagtcctgacaaatacaactgctttttcactaaactgtccaactttttatctgccccatctcattataccaaatataagcccatgtgcagcagctgtacaaacaggacaaaaaagaaatagataataggatgggtctaggctttggtcagcaaagaactaagccactgtccatgactggtgctccagcaagcacagctcttatatcagtcgctaatgtgcttatttctctcacgattgagatgcaagcaaattttaatagcaataagcaaagagatagaattaaaatgcaacattaattttactggcttctcacaaactgaaatattctgaagagaaaattgaaattagcatatactgagcttagaccctaaagtgttagaagccaaaaggttttagccttggcatggccaaaagcactgcttactttttgataatggcataattgctttttttcatatcagtgaaagcagaaacagaaacagcatattgactttataagtcataatcaggctggcagcctgtattagtctgttcccacactgctaataaagacatacccaagactgggccatttctaaagagaaagaggtttaatggactcacagatgactggggaggcctcacaatcatggtagaaggttaaggaggagcaaaggcacatcttacatggtggcaggcaagagaggatgctcaagggaacagcccttttataaaaaacaacaacaaaaaatcagttcttgtgagacttactaacatgagaacagtatagaaaaacccacccccatgattcaattacctcccactgggcccctcgcatggcatgtggagatcaggaaagctacaattctggatgagatttgcgtggggacacagctaaatatcttagcccttgccttccttaacatttctctgctggaatcacagatacactccatataacacctcagtttagccctggctatgaccaggtaggtgctccttggcattgttatagggctagtcttgcatattgggcccagcctcaatcatatgatgggagttctggcactctctgtccacttcattttccttaaccctactgcttcccccatccagaacctgaaacttctggttatatctaagacaccacctagtaggactgcattctgttctccatgctgtttactatacaattttctatgaaaagactggttgtttggaatcacagtaactccctccacctggccaagagaagcacagccactgtcatagtgtatgtctgctttggagttcattgtatattgagtcaaatctaaaattttatattctagtagacactgaatatggtttcacctaggtgatttcatgtgtttaatactgcatcaaaacatccttggcaagttcctgccttctttattcccacctttctgtcactaagttctctatattttaaaaataaaccttaaaggttatgaattgctgttggatatacaaatatataggagcaatactagttaggaggcttttgttagaatccatttgagagactatgttagtttagtccagtatgttagaagaggtaagagttggtcattttctaggtatttttgaaggtagatctgatgggattttctaaaatgttggatatgggttgtgccagaaagaatgccatcaaaggtgacacctctattttttatttgagtaactggaaaggtgagttgctgttatcctacttagagatgattgagggaggagcagctttggagggtacagagatggagaactagtttgggaatactgtttgtagtatctattaatcatcaaaatagagacgtagcattatttaggcaccctgaaggccaccctcactttaacaccagctgaaaagttcaagggcctccaaggccaccttcacttctgacaccagttgcaatttcaggggtcccaaagattactctcaagtttgataatttgctagaatgagtcacagagtggactgaaagctgttatactcatggatacaatttatagcagcaaaacaatgtaggttaaaattggccaacggaaggagtgcatagggaagagtccaggagaggtccgtgcccagacttttcagttgttctttcccagtggatttgtggacagtgctcacttcttcaggcaatgacctgtaacaatgtgcatgtagtattgccaactaggcaagctcactagagcttgaatgtcttaagtgtttattagggtttaatcatgtagacatgactggccacccacttggctgacctgtagtctccaacccctccagaacttgagctgatgccacatagctcaaagcctctaccatgaatcacattgtttgactaatcacattgttagcccaaggtgcccaaataaacaaaagcactcttgttagataggacatggcaaaggcttagagagtgtctcccaggagctaatggcaaaggccggatctctctttaggtaaaattaattctttattacacagatgccaaatagaaaagtgaatttaaaagtctagagtttgagaaagtggactggtaagagatatgccagcgtacagacagtgtattagagtcctagcagaaagtaaaattcacttagatggttttaatgaaaacattttgataaagataccccttacaggactgcaggcaagattttgagatcaagtagggcctgttgagacacatatataccatcctgggatccaaaggaaaagcagttaacagaaccaatgaaaagggttaacatgtgccaagcacagtgctaagtgatttgttcatttgatttttcctatatggtaataattattattatcaaatgcttataagggagaaaactaaagtttaaaacatttaaatacctttgtctatatttgttcaggagagagttaatgacctgggattcagcctgaatctgcctgccacgggctgccatgccacttatatgattctaaaatttgacattgttatgccacatataagatcatcctgtgggtttcagccgctctccatgacttacctacaaaagggtgtctagttagtgactctcccacttaggctttcctgagaggcttctgctttgctagatcagggttgtgagcatttctggtatggaagtttacaaatgggagtggagtagaaaaaacaaaaacataatggccgaattctcctgtggaaggaagttagggaagaggtaaactagacttccaggaaaacagaagcaaaggaagtatgtatgtgtatgattctaagtgtgtacacacatacacatgtacatgtattaagtgtcaaagtgtgttttcaggatttgggtgtgtttgagaagagaaaaaaatacaggattttagttgcaactgactataaatttgtacacttttaaaatgttttcatgggattgtaaaggtctgaattcctgctggaattctatttatttgaatgtatcatggttcaaggttatcaagtgtgtcctggcttcgaagagaacatagtgcctagaatgtatcatctatactgtattattattatgatttttgttacaaagcgtggaagggctttgccattaataaaacaatataatggatatgatttaatatcattaaaaataatcaagagattttaatatggggataaccattatataatcccaccatgcctatcccaccacctgggtcagatcccgtattgaaacatgcccctagacacagaactggactcagaaagattcttggcacagtgcttcatttagctacaaataatcaattatccctgacatgcaagttaaaactcatttgccacttggtttataatgtatcaagctaaaatgttttaacatgttctgggtcttcaatttactaggttatatcataattttaaaataaagaaaatttcaaagaaagaaggcaatatctctgtaaaattagcattcagacttgagtatgtcccaaggagactagccctccaattctattttgtatagctttcttttcctcctctgagaaggtgaaaaactctttgaagatttcctttcatttccttttctcttctctcttatttctctaagccccaattatctctgttttcaatgttctctgtacagaaaaaatccgcatcaccacccacctccagaaggagagaatggctgataaaaaattggagattggattttgtttcagtgccaatctactacttgtgtcaaaccattttaaattttctcattatagttagctctcttctctatttttacagcattgccacacattacaaaatccatagctggtacatatgcactatttagttagctttaaaacatttctgtagcccacatacattctaataaaattaattctttgaaaggccatactttggcttctgaataaattattatcttttctcaactgaaaaaaaaaagatgatgatgaaacatggaatatagatgaatcatttttgtgtagcttataatacaatgcattttgggttgagtctgagcttgcataaagactgactgaaatgataaataggcctgatgattaagccaggtggcaaatcactagtttgtgtagctgccaaaatggatacctgggtatgggaggaaacctgggactcccttcctggggatagggtagtcgaggcctgccgtagaagtggtgtgattaatctctttagaagagagtgccagctgcagtgtgcataaatgtctcctcctggattctccttaaaagctaaattgatgacagtctcttaaaagagcagctcagccctctgtccctgtaagataaagacaaaccttgatttcagctactactgaaataagtaaaagtagaaaaaggttaaaaaaaaataacagtactgtactcttagtgaaggaattagaggtaatagaatgttactcatctaccaaaatataaggataattgcaatgtggtacccttttttgttagaaggttttgtggagcccatctgtgcagattgtttgttttttactatcattacatcaattaattacattagggaagaaggggacactttaattaaaaggctgttttaaggagttataattctactctgtcattaaataatttaacaatttaaataggcaccaaatttgttagtaaagaataattctgaaaatgtttgtttgtaaattatttatattaaccacattttcagcaaaattaattttgcctttttatttcatcaaatcaaagcgtccattgatttcttcattttgaccaatggactgtaggataggaagacatataaaccatctcaattattttgagagacttattttttcctaaaagagaaaaacctctcattttaccaagtatgcatatttgcttgtgtgtgatatgtctgattagggtaatcttttctgcaattggcatttttagaacatgatgagttgcaaagagaagacatggctggtgaaaagatggatatagacccacagaaataaatatatagccaataatgtaatttaaaaacattgctgctacttaagtccatacttctttggataaaaaccttcatccacataagttatactacaggaatgcctttgtgtatttcacataaaatgggtggataaacatctattttttggatgtcttgaatgcatctttctttttgtcaaccatcttccatttttctagagtgtgctaaataatggaattcagagacttgtatctaaatgtcagggaataaggaaagcaaaggattaagaatgaaaataaatatggaaatatgagaaataatatcatgggacagaacaagagaggcttagaagctaagagaagattctaagcaactcctggtgcaggagttgatggaaagtgagaatttaaaaataatgattctgcattctgtatttaaactgttctctagactgtttctgtctgattgaaatagtaagccattttttttaaaacattgaatgtgaaaagcattatagaaactgcttttgtacttaaaaaaaatgccagagtcaaactgtatctcatgcagttgaagactgaataagtaatattattccagtcattatatttatctaggatcagtgtcttacacatagtggatgtgcaaaaaatatatgtggaatgaatgaatgaagataacattttactcaaatttttaagtaggagacggcaggtcctactagtagtgaggtttttatctttttttcactcttcaatgttattccccagggaaactggcaaactgaaatctgttacattaatgccagcagagatgtatgagtgtgaagagaataagtaaacatttattgtacctgatggctcaatggactatcaacatgagctcttaagagacttgaaaatacttggcagtgtttatccttaggatgaactctacaaaaactatttgtggacattattttcagaaaatttctattttggggtcagctgagctttttcaattcaaaacttatgagctaatatgtaactatataacgcctttcctttggcaatgagttaatttcttaatgttttttaattctaatgttaggttttctatctaaatcagtgtcaaaatatcatccaaaaatagagatagtagctagtacatttttaatacaatattttcccatgttacccaatataaacataatgacaaacagccatttactgagagtctaatatatgccagtttatttttcagagttttacatgttaaaccatagatgattttaccttcttatagagaaaaatatatcaaagctgagagtaacatagtgccttgcacaaagccacacggattgtaaaattttgaactgagattcaaacccaacaccccagctataatagactaaatcccccaaatttacatttgacgctcacaaaatcttgtgaggtaagtagggcaaaagcaatttttattttctttattcacctagggttgttatttgattattctgcatttatggaaataattttgtgagaatgatagaaatttaaaatgggaacaatttaggggtaatctaaattagcaattcttagacattttcgttttagtaccactttacatccttaataattattgaataactctaaaagtatttgaaatatgtgctatattccttgataccatattagcaataaaaattggaacattaaattcattattagttatttaataacaatagtaaactacctcttcacataaatattatatttttatgataagtacctagatgttccaaaacaaaaaaaaaagtgagaagggtagcattattttatatacttataagtctctttactatttagtttaatgggaggcagctagattttcacatctgcttcctcattcaatctgttgtaacatcacatgtcctgtaacgtctggaacactccactgcacatgtgtgagagaatggaagttaaaaaaacaaagaagggctgggcacggtggctcacgactgtaatcccagcactttgggaggccaaggcgggtggatcgtgaggtcaggagttcgagaccagtctggccaacagggtgaaaccccatctctactaaaaatacaaaaattatccgggtgtgatggtgggcacctgtaatcccagctactcgggaggctgaggcaggagaattgtttgaacccaggaggcggaggttgtagtgagccaagatcgcgcaattgcactccagcctgggtgagagtctgagactatatcaaaaacaacaacaaaaactacttagtattatttaaaaatagctagacttcagggacccttctgaagggtacaggtgtctgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcggtttgtattttacctccctcccactgatgacacaacaaccaacccgcacaacccttctgaaactacccttgcctggaacagcaatgatcttgttaaattcaataatcattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctcaatcatcttttcttataaatatctcagtattccatccacattttttctgcctgatattttgccctgactatgcatcttacctctcttacattatcactactatcttctaacgatttgattttattccttatttttatgtgtttttttttccaaattttattttagtttccaggtgtacatgtgcaggtttgttacatgggtaaattttgtgttgtgggggtttggtgtacacataattttgtcacccaagtaatcagcataataccaataggcagtttttcagtcattagttcacttcaaataatgaactccagctctgtctgtgttgttgcaaaggccatggtctcatttttatggctgtgtagcattccatggtgtatatgtaccacattttctggtatctaggttgatttcacatctttactatcatgaatagtgctgcgatgaacatacacatgcatgttttttaatggtagagttatattcctttgggtatatcccattaatgggattgctgagttgaatggtgttttaaattctttaagaaatctccagactgctttccagagtggctgaactaatttacattcccaccttttctccacaacttcaccagcatgttactttttgactttttaataatagtcattctgaatggaaaatatttgcacactatatctctgacaaaggtctcatttccagaatctacaaggaactcaagtccgcaagcaaaaaataatcaacctcatttaaaaatgggcaaaagacatgaaaagacacttccaaaagaagacatatatgtggccaacaaacatatgaaccaatgctcaatatcactaatcattagggaaatgcaaattaaaaccacaatgagataccatctcacactagccagcatgggttttattaaaaatccaactatttctttccccggttcttctcatcggtcctccataatctgagcaattcttttgaactacagattccaagtgggcacttttcacagctcttaggttaaagccccaattctttcaagtattttacaaaagcttctgaagcagccccgtgcttgcatctacagctgggcttgtcactgattcttctttgcttcataagattctctgacctgctccctcacttccatgacagtatataaaaactgtttattcttctatatgcattcctttgactctttctctttttattcatgtattaacttggatgtcacctcctttggaataatttcccctgagtcctcccactctgagttagattatcctgtatatgattcctcaatgatgtgttctttccaaccaaaatattatttgccagtcttcatttgtagttacttgcttaatatcattttcccctgtatacttttagtattgtatgcacagaaacttcatctgattttgtctttctatagtgaaagaataaccccattaaaaaatgggcaaatgacatgaaaagacacttctcagaattgttctacccaatgttgagaacaatgttggacttacagtaagaagattataagtcatacacatttgttagatgcattattaaatgaatattttttctcttttttctgcagttagttgtatttatggttttctgactcacctttatgaagttgagaatcttgctttgaattaattattttattgtcctgttagtataatatagttactatcctgtatgactgctatgccaaagtggttcaaagactggctctcgtatgacacctaaaaccaggtgaaaccaggcctatatttggaaattggcctcattcttttatgaccaagaaggtcatctgggaagattggttaaaatatgcatgcatgagttctaccctctgaagattctaaattggttgtttagattgtaagcagctccacagattactgccacacctttcaaagtgtaggaactactgacttactgcaagaatactctggtttatttataaaaagtagttaaagagttaccttgtaaaatgtactctaatttagtagcagagcactcccatgttcaaagaaatatatagttttctgaatgtatagttttctgtacatatatgtttggaaggacgtcatagccgaacattaaactctagcaggtattacaagttcaagtacctatttttgtttctttacagctcaatgttaacacctgtactcattaaacacatcttacttctctagaacttattgtagtatgtttaatggatgcatttaatatcaatttttatgtagtatttatttaaatagcattagtaaatatttaactttgcaaaacaaaatgtggtaatactattttaccatgcaatttttgcagctgttatgtgtagaagctgttaggtgtagaagctgtataacttacagtgaagcaactttatggggccatgtgtttttaaaacaaaatataccaagtatatttgtgaattcacattttttattgttaattgatacataataattttgcatatttatggagtataatgtaatgttttgacatatgtatatatgtactgatgacattagagtaattagcatatccattaccttgaacatttatcatttatttgtgataagaacagacaaaatcttctagctattttgaagtaaataaaaccttattgttaactatagtaatccttctaagcaacaggacaccagcatttattcttcctttctaattgtaactttgtacccactgaccatcccctctccatccctctcttccctctaccctccatttatttttatttatatttactcctgttttcaaaaaggttaagtaacaggtatgtatacatacatacagacagtacatgtacgcacacgcgcacgcacacgcagacacacacacaccacacacacacacacacacactcgagaaacagagagaaggaaaaagagacagtttctgattatttacaaatattttgctttatcattgtttgtcatactgtattgatgaaggtagtttttcagggaaaatagaaatagatactagtatagagatgagatttttaaaagataagaagaaagagtagaaggagaaaagaaaattgcttcatttgatccaagctgcaatggaattggatgatctttttttcttttcacactcttttatatagtggatcttttgtgtcagctctttaatgtgtttcattacttgaagactgtataaaggaatacattcaataatttttctcttattttaaaatgcatcacagttatatgacttattggaaatatattcattaatgtgatatatttttaatttaattatcaggtacttctctaggagaatgcttactttacaaatgtgtgcaggtatatttactttttaatttaatgttgttaactagaaaacaatacaaaaattgttagcattattttttaaaataattatggttcaggctatttaaaatctattttattaaggaaagttatttcactgttacatatacaccaacttgagtttccaggttattcaccagaacattacatgttactgacgatgaaaaccaagtaaccaaagtttctaataatagggaatagttacataaattaggtgcgtgataaaacacagtgttcattaaaggcaatctagaataataatcactgacttacaaggccctctaaggcattatcacaaaacaattattaatgtaaaatacaatacaaacaaagctatgtgtgtacacgtgtaaacgcacagaacgtgttatggaaaaacagtatttcaagcctttaatagtgacagcctgcaggggagtagaactggggtataaagggaaactattttactctatgtctttttatacatttaagttatttatattaacttttagtcatgtgtttcttttataacttgaaaaatgtcttaaagaatttgagaaatgtttattttaacaaaaataacagaggatatggaattgttttgaaacaggaatttcaagttgcaccattaaatacacttatacatggtcaagaaaattatgcgttcttggccgtatcaaactatctcatgtagtttataatatacaaacctatgtaaccacaaaaattaaaatgaaataagaagaaaattatacattctaatgagtgttttctgattctttgccctactctattttttatctctaatattcttttttttttttccattttaattaaaggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggtaacctttaaattacttcaattcttgttttcttcataaacttgcacttacaatatgatcttcttttaaatcaaaatattattgttatgcaatcagttataataaccttgatgtaattttatgatagaaagtctgacaattgcttttaattaattgtcttaaaagaaaagtaatgtaaacattgatgatcttcaaaacgggttgttggaagtttggaggttattttcaaatgactgcaatgctgttggttaatgagatagttgattaatgagatagttatttctttttgttttgaaatgagggaaggaactaagagtcaaccagttgagcagctcactcattacaatcagccagtaggaaaaagatgtaatagatttaccatttacctgatatttactgtaagagactttatatatttgatcttatttcatcatcactacaacaaaaagaagtagggactatctctactttacagacaaactgagtcccaaaatgaacaagtaacttgaccaatgtcaagtagcaagaacatagcagagggattgatatccaacctaatgatgttaacaagtattcattccagaataaagcattgcctgacaaaaaccaaccaaccaaccaaacaaacaaacaaaaccttctaaatcaatcaaacaaaacaatttgtagctgtgaaatcttttagtattatgtcagcattattcagacctaacagcaaactggaaaacagaaattattatcagtccatatcttacagatgaaggaactgaagttgggagttaaatggccagaacaaggccctacacttactatgtagtagagcctggatttgaacacaaatttttggattttgtttcttaaactcttttatgcacactgagctgacacctttgtagcttggaactagtcagtcatttagaaacctctcatgtataggacaaaatatttctactggagagttacgcagattcagatgtcaaattatatcccgttaaatataactgccaatagtaaatgcctgttatagcatggttaatttattaagcagatgtttatccaatattccaatataaatgttgattttcacagtaaaatatttactttgatttgaaaaattgctatagttttatctttggataatgaagcatatgagagtttttgggtttttttggcaacaaataaaacaacgcactaagattactactgaactctagagtcaagatttatttcacataattcccaaacaattcctgatcatggtttgaatacacaggcttggaaaagagacctttcctttactcctggagtgagtggcactaagctatttcagtgacagagctttggctgctttctctaggcttctagtaagtatgtaaatgatcagctgtcttttctctaaagaactaactctcactattttgctatctggaaggtgagaagcctgtcacctttaaatttgaacttgctttctgacttctattagatatatttattattttatacttgttttcttatgtgttctttgcaaacatgctttgtttgcaaaaggaaaacagaaataatagaatatttaaatacatataacagaaaaatgtaattttaacaaggtcagtagatgaaaaattagaaaataggtaaaatgagaatatgaaagttgagatgaatccagagcgacattattatacagtatgcatcctctgaggtcctataccagaagaccacaaatatggtggtgttatttttaactttgtctcacatttgaattttccagttattctagtaaccaagaagaaagtgaatagcttctaggaaattcagcagtgcatttaatagggtcctattttgtgatttgtgaaatttttctgagattcctgaacattcactgatgttggaactcctaagacatggtataggagttgaagagcaaaaatagatgagctttcagctagtctggcttcatccaagaatgaataataggactatgcagaaaaataaatggccttaatcagtttactcttgtgcgtttgtttgtgtaatttatttaatttatttatttaaactgattgagcttttactaggtattgaacaacagtgaatttgaagttttcctgctagaaagctttaaaagtgagtggagcttgcggttgagtagatttcctctgaggcaagttgagtacactaattggcatgcatgcctccatagcagatgattctacctccatccagatttatcaaagaaaataccctagggcagagccaagatcctctgaagtaaaacctcacaaggacattctatcacagggaaaaaatagtaatcaggaacttcaaagtttagatcagagagtgtgaaataaaaacttttagcctggaaaaaatgtaaaagaaaatgctaataaaatcctacagtggtgtgaagtaaaataaagtaaaaattgaagaaatgtgtataggcccccctcatattgttgaccttgagcaatatgatttctggatcttacctgaaaaataaactggttgcatattatctgcctagataactgcatgtgttaattcatcatatagcatagcactacaccagcttaatgttggggtttctaataatattttgactttagaaaatttaatctgtagtatttcttttaggagagatgatatgacaaccgcttttatgttgaggcaattattatattatttgtgcataaaaacatactgattttattctctctaatatgtttgaagtgtgcatacaattcactcaaaagtagcagtaagacatgctataattaaaaccagatccagagcaagttatttaaaaaaaaattctactggaaattattaactaatcttttaagagagtattcctgttgttcattctttttgagtaaggttacaatgtaggtacttaatcaaaaataactactatttctacctccaattttgtttgtttgtttgtttgatggagtctggctctgtcgcccaggctaaagtgcaatggtgcgatctcggctcactgcaacctctaccttctgggttcaagcaattctctgcctcggcctcctgagtagccggtattacaggcagctgccaccacgcccagcgtattttttgtatttttagtagagacaggctttcaccatcttggccaggctggtcttgaaatcctgacctcgtgatccacctgccttggcctcccaaagtgctgggattacaggcatgagccaccgcgcctggcctcccagcgttttctacgtcatatatcacagcacattaactgatccttgttttcaaaatcaaaagctgagagaaggtcaatgaaagccagaaacagactccaattaccctcatagatttcttctcaaggtgatgaagaaaaacctgtagccattggaaatacatatgtcagaacaaatcatcttcttctccaccatctcctcaacaacttcccctacaccaaagcagaatttgatgcacttgcctgagacgtccatgttttcaaattttcaaggaaggaacaggcaaaaattttagaatgcatggagtcaaaaattgttctacaactttgagaatatgaaatataccactttagaaaatgacatagattccaaactccacattagagacctggagtccatgtttactcactgtctcactttgttggacagtttattcattcttttcatgtcctagtttccttacccataaaatgaacataatagtaggactgacttctagggtttttatgaggcttaaatatgtaatgtgcttagaatagtatctgacaaattttaagcattatataagtattatttttagttatacatctgaatcgttatttctttcaattacctttatctctagttctatacctacagagttgataaagtaaaaaaaattgccaagcataatattgagctgtcattgaatggtactggagatagggagccatctgaacatatccatcaggagcaatgaatgccttctacaaatatgatcttgtaaatttgtatttaataagggaaattctgtcttattttgcttgagatgaaattttaatccgaatattattggtttatataagtattacccactgaagaaatattatttggtaatttgatacctaaatttcctgtgctcaattctttgatgccacctttcattaaccaatgtttctccctttttaaatatatttgatacattccaaatttttcacaaatatctattccttcttaaagaattcatgttgcagaactacaaattctatcctacctaactggttaatgctgatttatgagcatgatgcttttcttatttttattttttatttttaattgttgtgggtacatagtaggtgtacatatttatgaggtatatgggatattttgatacaggcatacaacgtgtaataattacatcagggtaaatgggatatccatcacctcaagtatttatccctgttttttgtttgtttgttttgtaatggggtgttgctctgtcactgcagcctcgactttgggagctcacgtgaccctctcaacctcagcttctcgagtagttgggactaaaggcatgtgccaccatgcctggctatttttcttttctatttttttttttttttttttgtagagatggggtcttgttatgttaccaaggctggtcttgggctcaaccagtcctcctgccttggtttcccgaagtccagggattacaggtgtgagacactgcacccagccagcatttatcctttatgttacaaacaatccatttatactcttttggttattttaaaatatacaattaaattattattgactatagtcaacctattgtgctatcaaatactagatcttattccttctattttttaacccattaatttctatatgcagaatgtagttgaggcagctacttcataaatgagtttttgtagttagtggcttttggaaggctattagatgtacctgagaataattgtttcctactaagaactcttcattcaactaaaaatgcattgttttttaattatccttgccaactgctgttcattgataagcagttatttcaaaagcattctcttatttttggagagaaaatgacatggacacttgttataactaaaagttctaacccaaaagtccttgtttttaagattgacagtctaaaattgatgaggactgtagaagagtgaaataaaacacagtaatttgtgactagtttattaataacaacaaaaacatttctttaattatatgtaatttttaaataagagtggtaatttacatttccttcattaatgctatggaaatgtctctaaagagctaaaataaatgcctgttggcattgtgttttgcagcacttttttcctaattcagtaatattgttcattaaaataaaatggtgttcctcattggagtatttgtagtgaagacgttacgaatgtaacaaattaagatgtgctaatttcaggttttgtgtcaaatttaatgccttctttaatgtgttaagccatagctttacaattgcaaacattcagctaatagcttttctatctagagaattgcttcagaaattccttcagtaaccactaatctttaactactgggaaaagatttagtttaacctaattgtatgtaacatgaatattgtaggttgattctttatcacatcctactatattttgttctcacttgaattactgacatactgtctttcctgaaatatgtaccttcagtaatttttttttttccttaggcattagctatgggaatgatgacagaatactatcattatatctttaccactctggtaagtacttcattaaaacaaaatgttctgaattttattattatgactttttcagatgaaaaataggttttttagtaagaagtattatgactgattcctttgtagttatattttaatttgataagactccaccaaaattattatcagagaggacaactcttaatagaagctgatgattttgaaataatatcatttcagatatcaattcaaaatattgcatatcttatttttatgttgctttagagaactttcagaatataatggatcttgaaattagtttcctgagaaatcagtgctttagaaaagcgcaaattcagccgggcacagtggctcatttctgtaatcccagcactttggtaggccggggcagaaggatcacctgaggtcaggaattcaagaacagcatgaccaatatggtgaaacccatctctactaaaaatacaaaaattagccgggcatggtggtgggtgcctgtagtcacagctactcgggagcctgagacaggagaattgcttggacctgggaggcggaggttgcagtgagccaacagtgccactgcactccagcctgggcgacagagctagactccatctagaaaaaaaaaaaaagaaaagaataagacaagaaaagcacaaattcttatgttatctcagctgtattcactttttgaaaatcagatgtattgaagctgtcctttcagtagattacattttctattctgcttttgcctgtatttagttagattttttaaaaagtcaatatactttaatttgccatcagcaaattgaatgttacctttatattttgttttcacatacccatcacacaattttcccttataatgtatgaaaatctgactttaacctgtatcaaacttactgttagctccattttgttatcaatacattatcctgacctttctttctctgtaaaacagctgtctctttactaattctttcttccacatgtcccaaatatgagtatctccaagtttggacttcatccaatcttattttctcttcaattattttcttcagaactggtttgtatttagagcctcagttaacatcttcgttcgaatgaggtctaaatgttctatgtaatatttatgaattactgtatactgtaaaacacttttaattgttgtgccattagataatttcgaaatatttaaactttagtgtcctctgaattgacgtctcttctgattatcttaaaaatttcaacttttgttgactcctgtatcaccaacaaaattttactgatttttcctttgtagtgtctctagcatctatcttctccattcccataacaaccagtctaaccaaagttttcttcattaacttgaaattcttccagttagtctccttgcttctagaagtcttgaagctgccagatcagattattaaaatttaattgattgcaatagcttcctgtgatgacaactcttacctccaaaggagattattcatgcagtaggatgtattttacttaaaaatagcaaagctggctctggcatatctctatattatttcctagcagacaactttttgcagcttgtaagaaacttagtggtgggggtggagaggaagtgagagcattccctcatcagcaaattatatttcagtgctgttacaactcagcataagcgtaagattttggggaaatcaaaagtatctctcaatagggaaaataaatgaaacaactagtttaggatacatagaactcataggcctacatttgaaggccttttatactttgatcctaatcgaactttcccatttccttttgctactattctcctttaggaattctcatttatagctgaactgatgtggatcagtctcctgaataggttttatatcttctaatttttgtgtctccactcacactttgaattctctttttgtcaatcatcagcccggtctttctttaatggcagctgtaggggagaaaagatttcttttcctcacacttcatgaggttcaaggctgagatctctataacaaaagagaggttgacaagagaaacacctaaaaatgtatttaatataaattttatgtgacacaaaagccatcagaaatgaagactcaaagaaatgggaaaatctggattttttttttttttttgctttggtttgataaagagtagatagttatgtaggaaaattattggacaaagggaggttatgatctaatggcaataaatccagaaaacttagcaaggccaaattgttgagattcttcttgacctccaggtatagggctggatccctctggaatgagagtcttatgacctcctttctgtgggggtaggtcagagaattcttttatggtccacttcaggggagaaaggtgggataaggtcacagagtgaccttcctgcttctgtgtcttctcaatttcctatagccaagtaccatatttgggggtagcatgttctgagcctcatcacagctaagatcccatctgctctgtgaagtttttcttgaccatacaaattgaaaataacttgtcttgcttctgacttcttttgcatttatgatttctactcttttaccacttggcatatattgccatcctttatttattcacctctttcctatctccttggctagattgtaaacattaaaaaataaaaacctaaagattcctatgtttttcatagcacagactagagctcaggccaatgccagctgctttccactgaattgtattcttattatctagcctgtgtagctgtatgagtctgaggcaagctgttcacagaaccaatggcattaatcttgccttgattctcaatattgtccataagttcgagggttagctatgccaactagaaagagggcaaaactccacatgctggatgttttcatggtggcatccatttccatgatagctttggcctcatatctcctgggacaactaaagggcagagcaagaaagttcactatatacagactagaaagggcaacaggcataaagtgtttattggaaacttatagtgaagttcctaggtgtgagacatgagatgaaggaactgtattgtttctgcaaccaaaaaggctagtcttggccttagcatttttttcacacctttcatacagttttcattagttagaagctgtattttgtgacttgctttctaaaaacaacaatcaaacaaagaaacactgacaaaaaaaaaattaaaaacagcaataaccaggcgaggaagcaggacacagaaaaaattaaagcaaaatattaacacataaaataagggcaagctatcctaaacagagagaagaaagctattgcaaatcttagatgtgagttgtagaagagcccattgtttcactggcggatttagaataaaatatatacatagatttttacatacggagcatgtatctctgcaatgccaaagcatgaggacagtctatttgaatcttggtgatttgtgatgtttaacgtcacttgacacaaaggtgttaagtgacctaaaaaaaacaaaaaaagtgactatttcagtaatacatgcctgtgaagatactctgtccataataacaacacaataacatttgtctttcaggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacggtatgaatacccacttaaagatcagtttgtgtgtttctaaatagtattgcatacatatgaacttctgggtttatatgcatacatataaacttcagtttaattgtttgacattaaaagcaaaatatcagagctacaatgcaaatacttgtattaacaatttttttaaatcaattttatatgaaaagcttatgcttccatccaagtatctcaaaaggcattacaactatcaccagggtactacaacataggaatttctgtaaagttaattagtgccctacatgggagaaatgagagactgaaagaagacatacatctggtagttatccttctgatcttacctatcaatatacgaatactcttcaacatgatgatttctggtatctggtgttatataaatgacttatgtcacacaaaacacacaaaattctcgcatgagcttactcactctttaaggctgaagactaatcaataatcacatttgtcattttcaagtcccagtttaaacccagaagcggcactattgcataaactatgaaagaagggtatattcttatataacttagttgtttatgccaaacaactttagttgtttataccaatgcttacaataaaaatctaatggcaaggcatacataattttaagttttcttatactgtgtcctccaaaagataggtaaaaatcagtgtttgtttaagctactatgtaaaaatattatttttaaataagtaatcaatataaaaattatgacttcagacattttatattttttatactaaatccttgaaagatggtatgtatttgacatcatgcatattaattcagagtagtcacatttcagtcatatttactctgtagtagccaaatgtggctagtgtctaccttgtcagacttggtaggtatgtgtcatgttatttttgaaaattataaatgcctgatgttttcttattaaatcatttttctacagactaaagtatcactataattaaggaaatagcttagcagtggggtgatatttacatttcataggaaattaccatctgcttttaatgagtattagtctaaatggagaatttataaacaaaaacatcctctatccttacatgtatgtagaaaagctttttctattatgcttgtaatttttccattaattacttcaatagcttcaaagcttgtttttgatactgtagggataaaaggaaaatttgatttttttatccttagaaggttttgtaatacaaattgagtgccttcatagagactatgaagaagaaatggttagcctaaaggcatcaactttctgatggaacaaaaaatacatttgttttcagtttgtgagaaaaatcacctactagaatttcaaaatatatccgtatgaatttgttttaaaagaaacactatagggaaattgtacttcgttgcataaagagatagttgaacagttctagtagtttagttttaacttatgtttgagaatttttattgagaggaaaatacctaaataacttaaaaattaaaatattttccttcaaagtggagccagatttaaaataaaatgcaaactagaaaaaattataaatgttatattttattaccagtttaaagatggtgaatcaaacttttgaaacttaagacaatgtgattttttaatattataatgtatgctatcctttaaattgttgttatgatcatgtgaatatttttatataatatataaaaatatttattatataaaaatatatattatataaaaatatttaaatattatataaaaatatttatatattataatagctttctttacaattctttgatttcaggatgaatgtcttattatttattttcaatagcactattaaatggttttaagaaaagtaaatcagtagatatcagcacaattttacacttttatatatttacttccacagataaataagtccaatgactaatgtgccccttcatgtatcagaatcataaaaattattcaattttactttggtacactctgtatagctatgtgagtccctctgtgactttacacatcatctcccgaaatgaagtaatccctaatttgtggcaacttatgtaaactattgaaagacagataagtacaaagaatgatgtattaatttccaaggtagaagctcttggagagaattaacctctacaatatggaaaaagagagaggatattaggagaattacaaatttgcattctctctttctagcacgagtctattcctcttctgcttttccctgttgaactggcagatgatttcttggaaggggaaaaatgttaaaatgaaaatggactgatgaaaaaatgtgtctattaaaaatcctgggcattatatataaaccatggattctgagttatttagaagaattttccatgcaattctctttcctttggtatagttcttaaatataaagtagatatgaagtttgtcattaaaataaaggtttctttcaaaatagatgcagattgattttgtttttacaatttcccttttggaaaattaatatattttaaaatcctttcatcatataacattgtaccaaaattttaaaaaaatacataaaatattttcattatgtaacattaattcttaattataaaatagcatatggttattaaaataaaaccaattgagttctgtattaaaatgtgggcatatttatgtcttacataagtattctttttcttttcaatttaaaattgtaagcattttcacaagtcattaaatgtttaggaaaagaaattaataagctgtttccaccatgaatatagtcagcaaattaagaggattctagttagaaaaaagagaaaaaagaattatagcctggcattgtggcattggcaacattcccttcagtcaattcatgagatctcagtgtttatgtatctctttttctttttatcccctatagtcccataaagaaatgggattatcagcaaagtttctagtgcttggagcaagacctattattatcagtatcataatcatttgccattgtgtaagatcatagtgctcagactttgacatcctttcttcatgtttgagctataaaaggaaacagtaaattggattcataagagtttttctagttgagttaggattttaattggcctttgagatgactgtttatcagttaaatgactactgaatacaaaaccacttcgcttgccattgtagtttctttctctgcagtctagggtcatcatattaaagatgttaatgttagtaactcagtaaaatttttagtttcacttggtataaacccaaccaaggaaccaactcacacagtacttccaagcctgatctagttaaggaggaagaaataaagctcaacactcttcttttacacatgagggttttcttttaacatatgatatcccacttttctccattcccacacaatgccatccagttagtgctctgaacttcccagacataaaccccttattgtaaaactctttccatactctgcattctgtattgtgttcccatcttttcatgctcctagaggtgtgcaaatacctttcaatgagcgttactactgttctttattgcaaaatcagataacatcttccccagtcctctgaccagacattgtctgcctttatgtagcacatttactataggatgagaattcacttttgaaccagtgccaatcagagcccgacaatggtgatacttgttattgatttattgagtttacagcaatttcaggtaaagacaaacacctcagagtacattttaaacagtctagctatatcccagaaatccttcccagtggttctaatatacatatgcatattaataccaatgtacctgtaatccattcagtagcttaatttaattatcagtattttttttcttgtgctgatagataataccacatatttccttgataatataaatgtattacacaaatcaataataatcatattgatagactatatcatttgggtttctatagggatattactgttttagaagtttaaaccctggacaccaaccgctatctccatttcctttcacctcaaaaatcattaagcactgtcaattttactgtatcaatatttttcttaactacattcatcttttcaacccagaactttatcttagttatgatcattccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttgtccagcctcatatttgcttgctccctgttccaccaagccaccctctcatctcacctttgatgtgttgtcactcatcatgtatcacctattccagcataggatacttcattatttaaaccacttacctttttttgaatgtttggcatattcctactcatactctaattttcaggttttctgttaccttttagattgaatgtgctgagtcctccagatattttatatgtgtggtcctttatttatgcactttatgtataactccatgttgaaagttaactctagtgctttagtttctttttacatcactttttcaatagactgttagctcttttgaagcaagaagtagatattgtaatctttgaagtccctatacctagtttaatgcctggtgtaaaacaggagctcataatgagagagtgactgcctgattgaataaatgcatttgttaatttattttaatcatattacatctgtgttctaatcattagttcctctaatttccccaaatatatgttggagagcattttatttgccctcttgtactttattatcaatatatctaatcatttagaagatgtaattaggctagtctcaatgacagaagcttagaaatacttttttttcttttttttttttttgagacagagtctcgctctgccacccaggctggagtgcaatgacagtctctgctcactgcaacctctgcctccccagattgcagagattcttgcgcctcagcctccgagtagctgggattacaggcgcacaccaccacgcctggctaatttttgtatttttgctaaagatgggttttcaccatgttggccaggctggtctccaactcctgacctcaagtgatccacccaccttggcctcccaaagtgctgggattatttataggtatgagccactgcgctcggccattagaaatacttttgattaaatagtgaaagtatagtaagttagaagagtagttcccattctttttacaaaggaagagataatgtttatgagaggtgagtctttatgtgttttaattctaaagccctaacagttatttctttataataacagaccacagaccccagactttataatttccttttttatttgagtatcttaaaataaaaatgagcatcttgtatatacatcttacagcaggaatttagctcatccactaaggtgacacaagtaatcatttgttactgtataaagatttacttgtatagctgggtgtggtggggcaggcctgtagtcagctatgtgggaggctgaggtgggaggatcacttgagcctgggaagttgaggctgcagtgaacagtgttcacccagctaaactccaacgtaacaccccgtctcaaaaaaaaaaaaaaaaaaaaaaaaaaaagcaatggaaatagaaccatagagaaataaagtatgaacagaacagacaggctttttcatttactgctagaacaactgcaagcccacctttgctgctatttgcttgtcttaattaattttagctgtttttctttaattcatttgaaatgaatataaatataaggttttggcaagtaatggatcaaaccaactcaacattttttaaattggtgaagcattttgaaaaagttggcttcatcttatattgcactaaatcaccaaaataaaagaataaagagtagcaacataatgaattgatgaattaactttttaaaaatcaattttaatactgtgtattgtatgcagcacacaggatttgataccaggcactcaggatttggtaatcaagacaatacctctatttcatcaaataactaagggaattgataaaatcagaagatagtaactgtttttctgatcacttcacaatctttgttgatataacaattatgttcaaaatgtgatgttgattgcttcttaattttgtatttttggatcttctttcctgtcttcctgaaaattcttgttaaaatttcctgttttccgtaatcatttatgatagcaagagacacacatatatttaccaagaatttaacataacttcttagtattttgtcgaaaaatgtgtaacatttcacaaaatttattaacataaatgttataactactagccttattcttgttgttaccacagaaaaaacattttggggtccataatataataaaatatggcagaaatacttgtatatttcagagtatgtaatgaagtcataagtacaacatttgttacatttatatatgcttgatttaatgaatggtaaaaggacatggagcatggaatgtgaataacagaatggcactatatttctttattttatgtacatattaatcttctaagatgcactaagctacaagttaaatctaaatacaaataattgagatgacctaaaaacctccattgttttattaacatagaacatttcgtctaattgccttttctcatccacagattaaataagcagcatttaagcatctaaaattgatggatatggaatttctattttaagtaattgttttttacatgaaaaatggcagttgcagtgaagcattatctttatggtcatattatttttataggtcaattttcaaacttttcacttgggaaaagtaagggtaaatcaagagagattttttccccttcaccctgaagagcaaaatttatcttcaaagcattgatataatattatgtgacaccaacttataaaggataaatacatttctgcacacaattttcttcagtctcttattttatatttaaaaatgtaggggagaaaaaaaaaaaactttacctgtcttaggtttgttcattgtctgggacctctgacagaagacagactaacatgaaaaaataactgaagttcattgttgtatgcagcacctactcacactgaagaactcagatgggaatagctcaaggggtggttagaacgtggacttattagcctcttaacaaagaaagatatctttttagaaaagtgccaatacaaaggaaaagtgatttaggcttttaggggtggcaaattgtgagcagatagatatatacatataacattatataaaaataaaaaattatatatatctaatatggcacttgtaggatcatatgcatatatatgtgactatatcatatatatgtatatgatcatgtacagatatcatgtgatatgattatatcatatgtatatgtatatgatccaacaagtggcatattttggggtggcatatcctgaactccttcaacagctatatggttttacgtggatatgacgaatcaccaatgatatgaggaagtctagctagacagaaatttgtgacgttcaggaaggagggcccctcaaggacagtcaatgtcaaggacacccagaagaggtgatgcccaatgccctgacaagagcatgaagtccaactttgcagagtctgagaactgacaacattctgagatttaagactccacatctgcatctggactgtggcatcaaggtagaattaataaaagcaatgaatgtgaccttgaaaaacaaaaatgccaagctggttattgaggtaacaaggcattgaacttgagaaagcaagtacagggcacaaagtaaaggaaatacaacatggtcaagaaaatagagaatggattatttcactggggtcggcactcagattctaacctgagaatgaagttaacagcaagtttgacataatgttcaatgctgtaagttaaaggagtggattgggaaacagtgggatataaatctgggataatgttttttcacgctaattaattaaaagataattataaatattctacatttaacatagaaaatcaaaataattaaaaagcatcaaatactggttgaaattattaaagaagagagagtaagagatggaattgaggcctacaaataagaaatcttattattcaaatattcataatatcctacagcaaagttctggctaaggaagtttattactgtaactatagtgcactctcatcatagaaggaagagtggatctatttttaaaatgtatagaatatgttttctggctactagtttgcattcagggtaaaaatacaccaaactaaactatatgttgtatttgggatgaactaagatggagtagactggtggtaattatcaaagctataggttttcccatattatttcagttttatgaataatctttggaatttgtttttggctcctccccccaaaaatttaaaaccaatgccatataaaaaaataccttggcctcatcccagtctttaaaatttgcatttagttgaatacttacatttatatatgattttatataaatataaataatataaaataagagggaaatatataaaaatatataattcttatttatatctaaattcatattatcatattatcttaggtaatatcttaatacgtttgtgctgctctgacagaatacctaagactagataattaataaaaaacagaaatttatctcacaattctggtggccaaaaagcccagatcaaggtattggcaggattggtgtctggtgaaagcaactgtctgcttccaagacggcaccctcttatattctccagaggggaggaacactgtgtcctcacatggtgggagaaaccaaagggcaagagagtggtcctttcagcctggagctcttttataatgttgctaatctctttcatgagtgcttaatgcagtgatgatgacttaatcatctctcaaaagccacaccttttaattctgttttattggggattaagtttcaacatgaattttggaagggggcactgtcaaaccatagcacgcacttttgtgaatagtaagcaatattcatatttatctatttaatcatattcatacctatatttatctatgtactaaactatactatttatacatatctatatctatttactagaaagacagtgtcactggtcacagtattaataggataagcatttataatacatggacttggtacactcagtatatgcaaatgctctttgacttatgacaggattgcatgtttataaacccatcataagttgaaaatatcataagtcagaaatgcacttaatacacctaacctacctaacatgatagcttagcctcacctaccttaaacatgttcagaatacttacattaagtaagtattacttacctacatttggacaaaatcatttaacacaaagcctattttaaaacaaattgttgaatctctaatggaatttattgaatgctgtactgaaagtgaaacacagaattgttgtatgggtacttgaagtacaatttctactttttgcatatggcttttgcaacatcataaaataaaaaaaatcacaagctgcaccatcgttaagtaggggatcaattgtgtgtatcagattttggtatatttttgttattaaatattagctataaactattaaaatattaaaaaacaaatgacacacgtaactgtagattgcatcaattttagaatcaatatgtctgtaagaaatttaacaattttccctgctgtgatttataatgaacacattgcagctttttttagtcatgttcaattttagaggaattttatttaaaaatagagattctaaaaactatcataaatatagaacttggcatataataaaatttatattatatataatgcacaataatcctacctctgatgttttaatataaatatatacctcagtagatatttccatttcttttgttttaaattacctacctctggatcccaccagtgtagaatttctcctgcctaattgatccaaaaaagtactcaactctgttattagaaataagagtatatgcatatataaagaatatgaattttaaggatgttaggatgtatacagtggccctaggaatagtgacccaaacaatgactttatacaaattctgagtctagctaccagcgaatgttactatttgtatttgacatctaatataaataacctaaattgtgaattgtatttaatgcttactgcattttactgctgtttctgccttattaactcaagacatcatggggcagttatcatcttcattttatagattcagaaacatagaataggcaggttatatatagaaagaaagatccctaaactattgtcagaagcaaatataaaagaatccttaagcatctaaaggaaaaagttgagcatgatgaattagaaaccaggaaaaaaaaattactttagatgtgcagccagattttttgcttcatttttaaccttatagaatttcacaccagttttgggtaaggtggtagctagttggtctactaaaccctgttatttctttccttacagactaaactcatacatagaggtcacaagccatatctgaatctcattcccaaacctctctaatgctattactttaggcaagttacctaatctctttgagcctcactcgtcaaatagaaataataaattttagtgggttgtcataaggatcaaaagggataatgaattcacatataagatgatgaaaacctacctggctttttataattatgagttatattattgcctcctcttaaaggccctgtgacttataacatagaatttgacagagtgcttgtggtttaattaactgattcattatttcagcattaattatcatctgttgtatgcaaaatcactgtagtagatacttagggtgtacgtgtgtgtgtgtgtgtgtgtgtgtgtgtgtgtgtgtgtgtgttggatacaatcataagaagctttcatacagaatctgcttaaaacttgaatccagtagtcttctttttaaaatgagcccaattacaatgatttaaaatgtgctattacaataacatatccctatttaacagatatttaagtctaggtagaagtttatgaaaatgatatgtatcattttttctcaatgtcagatcatttcgtttttaagttaaaaagatggcttgttggacacagaattaaaggatggatttttggttaggtttttcatgcctgtagtagaagactattaaatatattctatttccatctgagagcaagagttttgtaatctaaatcacctaactcttgaaaacagtctgcttattccttcctttgtaaacttctgctaacagtttaatatttctgagcctcagttgccttagctattcgatgaaaccagcctacatcacagtgtcactctaaagattgaatacataactctggcaccacttgaagacagtgtctggccagtagttgatcctccataagtgatatccatttgtttcaagataaatgccctttcttcactttagtgcagatgctactatgttctgagtacagttcatcattctcaaaggatcttttgatccctgtttatacaaaagcgacaactgaataagaatgcaactgtgtaaatatttacttacttttaaatttaagagtaggtagttgcttattttaatgctctgggtgagattaactaaatgaatgaacatgacatagctagtttaatatcaaattgttgatgcttttttttcatgacactatctgagtaattatatttacattagaaaggcaaattttaaaaaatgtagcctatgcagttttgtgatataaaggcctaagaaatggtcaagaatctactctgatgcactaatttccaagatatgcttggccaatactttttaaatccacattaataaatcagaagaatgtttcagacaaaaatgaaatgaagagttttagggtgaatttgcctaacggatattaggaattctcctgctttattatgcagaggaaatattatgttgatctttcatttgcctttctaaaagaactcatacatattttattcattaatcttcagaatgccctgtgaccaaattgaaccagaaggggaaagtgaagttagtaaacagacacagatgttgaaatggtaccaaatcgatccttcataaaaaacctcctatgtattgctattcattcattcattctccaaatatttactgaacatctactctatgcaatgtatggtattatatcatgtgaaggataagaaaaatataaataaatagatagattacatgatgtttgcacttgaagaattatcagtttaataagacaagtgaaacgtagccttaaatcattggaaaaaatatgctggcatgcagtgagaaatgtatatagaaaacagtgcatttagatgagcatttatctactttttgtttaggatataactataactttacataaagacacaacttgagaatgttatgtgcccaattaacatgaagaatggttcactccctttgtagttacctcactggacttggataaaattctacattcctgtgataagtcaaagaaactcagaaacttgatcaggttgagcagactggttgatggaaccacaggtttcattgtaagatgctcagcacatatgtactctattcaagctagagaatttcatagctgctgccaggtttgaagtactccagaaagtgctaccacagtgctagagttactgccagacctggggtcctggtatttctgctgaaaatatggcagtcaaatggttatctctgtttatcctttcttccattgccttgagtgttgaaggccatttttgccaattgtctcctcacatcctgtctggtcactcatcactagtactagagctcaaatttactctcaaattgacctggactcccactattccagctgtttagttatctggttctttatgcaacaaaaggcacctctgagtctgcccatagtggctgagttaggacccccatatcagtcaaaagctatttccagatccagctcttctctgagactatcaggccttgtctacactgtacttactttcagctgagaatgtgttctctcacctaactccacttgagcatcctcagtccctcaaaggtaccctggattgtggtcttgattgtttttctcctaggagtttctttgattctttgtaaatttttccactttctttctagcaactttcaagccctgggtactactaaggagtgaaggacagagcagtgtctataaatccatgtatatagttgcaatttaagaaacagaggagagagtagtctcagtaaagccaaatatacatggctaccagagagaaggtgcaaagttgactttaatctatttaaaagaaaaaagtcactaaatgaatccattcacaatatgaaaacctacaccaaagccgggcttggtggctcctgcctgtaatcccagcactttgggaggccaaggtgagaggactgcttgatctcaggagttcacgaccagcatagacaacatactgagactccgtttctacaaacaaaatggaaaaaattagcctggcatagtttcacacgcatgtagtcccagctctttggcagtctgaggtgggaagatcacttgatcctgagaggtcgaagctgcagtgagccgtgatcatgcaactgcactccagcctcagtgacagagagagactctgtctcacaaaacaaacaaacaaacaaaaatccctatacaaagagaatttgatatttctatcttttcacatagaactaaattaataataataataataattgttattgttattattttagcatcactaagtacaggacacccctgctataaacgttataaaaatttgacagtttgatgttattggaaaaggaatttgggggaagatagggctcaaactgaatctcaagtataaatataaacataaaatagcattttgataaaaatagatgagagtaggaaggccatttaggaagaagataatggaaagccattaaagatgttagaacaggagagtgcaataaaagtaatatcatttaccatgccttgctaaatatcatgcaatttgtggtgattatataaagatatgtttgccttacactaactctaagtctcacaaaaatgctgtaggatgagcattatttctcacttacagatgatgggactgaggtgccaatatatttagcatgttgctcaaggacatttgattagtaaggttaaggctgagcgtttaagatcagtcccttctaacttgataacttgtgcttttcctgccctatcctgcttccaggaaggcatatctggtggctctgtgtgaatgcataagacacactccagcaggtagcaggcttcctgcaattcaagcctgagttaataaggactggtatagagcccagggggctcaaaggaatgattgaatgggaagatctttttgagatagggaaggatagtacggagacaaaagaggccttagagctttgcagcttaggtgactaggaagactctagtgcttttcaccgaagtggggctattgcaaaagcagggagcttgaaaaggagatggtattgattgcaaacaggaaaatttgagatgatggtaataccttaaaggaagagaggtccaacaaaaagctggaagctgaaaaattgtttctcatttctataatgactcagttttctgtttgtttcagaaatggagaaaaaaatttcagacttttgggagcatatgtttacaatccttcagagaaaaagacttagtcaacctatttggccacctagactaagtgactccagaagctgagagaatttaagtagtgttgaatgtcaaagaattactgcatactttagtgcccttgtttctcagtagtcatgccggaacagcctgtgccttcgtagtacctgtgtcaggggtcttacgaataatgccttgggagaagagatgttaatttgaattctggttccggctttcaagcaaaatattactcttgctaatgttgtctatcaaataaacttctcagatttcattcgcagccttcaaatatttattcctatttccaatttttttactaaatcaaaaggaaaagggaagtgaataagtgataaattaaagactgtgagatgtctttaaaatatgaacttctctagcccctaaggcaggtgcacatgaatttaactgacaaaaattatgcacagttttcttgatttgaaagtctcacttaagtgttattttaactaaaatttgaaacaatcaaaatctcaaggtaaatatagatattactcacttttaaaacatcataatttgaacatttactattacatagatattatgtactgtagcaaatttgtaagctataaaaatatgtggaagacaattacaattttccatttattaacataccaagcaaagaaaatgacaattatcattttaaggaccagtagaagttctcttaacccaccttcccctaaccgatttgtaagagtaaccaaagctctgtatccactggttaaaatatactgattgacatccacagaagtgagaaaactcaccatcaggaggctactatcatgtttctgtattttgactccgtggtttggtattcttatttttctataaccagtttattcttgttgtacctactaattcataattcaattaaacattacataaaacagttaaataaaagtgcaagcataacattgtttctatgaaaactcaaatgactgcatgaaaaaaattgataaaggtactttgcaagtatctctttattcttgtttcacttaaaagaaacaagttgaaaatcatggataatccattatgtttggagcttatgcaaaacagaagaggaaattcaatcagcagacccatgaaaaaggtcttggctctacattaatacatttaggaatacatttacagttagatgttgtacattaacatagaaattttgaagtatatatgccttaactgtttaactggccaaatgttagctttgattactttggaaaattatttataataaattttctgtgcccttgtacatatttcattaaaagtaggatcttatggtatacacagcttgcttaatgttttcttaagttaatttaacatttatttaaaatttgctatgtctcaagcactgtttttggaatagagctatagtggtgacttagatggagttcaccttctatgtggtacatagaaaatataaacaatgaaagaaaacaaattaggataagaagatggagagtgatttaggtgtggggaaggccctttagctagggttatgggagaaaaatatatgtggagtaagtcctaaaggataagaaataggtagccatacaaatattgatcagaaaagcatcctaggcagaaggaacaattgcaaacttcttgagatggaaacaagcaaggtgcatctgagggaaagaaaaggtaacccagcacactgataggttgcctttctttcataatttgtgatgagaaaaatcaagggtatccttttgatgcattatatttgaattgcctattagatatccaagcaggaatatgcagttttgtttactagtgtattatttgagcctctaacagtatttggcacattaataggcattcaatcaatatttgttgagtgaaggaaggaattattttgggaaggaataattttgagatgggtaatgttttacgagtttgaaactcaggtgaaaggattgtagaataaatttgtgagtcattagcacatagataatatttacagctaagaaactggttaagattatccaagggtatagtgtgaatagaggagtgccaaagagtgatcttagaagtcaagaagagaaagagaagcaaaggtgattgaagatgtgcagtaaggtagaagaaaaacaaaaagagtctaatttcaggaagactagagaagaaagtgttttgagaaggacatggtcaattgtgtcaaatcaagctatgagaactgcttaattttggtaagcttgaagaactaatcattttgatttgacacgaaagcattgttagcgacctcaatactattgtctgcttggaatgttggggacaaaagctaagctggactgtattgagggaatgtgaggtgagagagaagaggtatcaagtctaactagttatttcaatggggtttcaatttaggataccatagaaatgaacctgaagagatacataaagtcacataaattttttttaaacattgaattaaggcatgtttatataggtataaatattccagtagagaaggaaaaaataatgttgcaggaaagagtgaagatacttgcaaagctgaaatctaaggaagggacacttagagggagttagtcttagatagaagcagggattgtttattgcattataaaaaaaaaaagaagacagagtgtggaaattcagatgcaggtgggtggatgaatttgggcaggacagcagagtagttcttgactcattttctccattttattagtgaaaaatgaagtgagtataccagcagaaatggaattgaattggaagagaaatttagaaggtttaagaaggggcaataggagcaaaattatctttttggaaagtgggaaagtgaatattctggggaaatatggaacattttctgggtttatggcccacttgagattaggggccataaatgttaagtgatttcagttaactgcatcctactaaacccagaaggacagttaagtcagcaaatagttaaatttaatgagtttaatttctctaagagaccatgatggagaataagacctaaaagagttgccagtatttataaacaaataattataataccaaatcatagaagttagaatggaagtaagggaatgtgtgaggtgctggacagtgaaaatgtggattgaagttctccaagggggtgaaaattaggtggaatagggtcatttgagtcactgggctgggaggataggggatttgttaaaattaaaagatgcatgcaaaaattaaaagatacaattaaattttattaagcaattctaaattgtcttctaaaattgctgaactaatttatacactctccaatgtgtaccatactattattcattatgtttttaaatcaataataattcttagaaagttatttagacttatttgtttaacaatttaaatagaattgaatctcgccattattttgtgggctagtcttttttcagaatatgtagcctcctcccttctccccaccccccgaaaaaaacccatgtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttcttcttttttttaactgtagcctatttggtagttcctttttcctgtgaaacatgtataaagttctacaaaaataccaaaagtttaccatatttattgctaagatgcaggtatactacattacttatcctcacatcattagacgaaatgcatatgaactctccttacaactgggtattgaacttcactggtcattggttattagaacattttcttttaatgactgtatctttttgtaagatacaagtgttactttggagagaggtaggaatagctctatggaaaatgtacatgtacatgtggtggaatttttcctgaaattaaaggaaacatgcagtttggtcaaatgcatcaaataaattaaaatagtgacggttactgcaaccgaatctgctgtcttaatatgctatcaatgtaaaacagcaatcatttataattgtcatcaaatgacaaagttaagtgtgataagaatattttgcacaccaattaatttttctatcagttttgatactttaaaatgttgaacatacagttctttaaactgcattgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagagacagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggctttttaaaatttattttatattatgagtatataataggtgtatatatcatcaaatattgtatctgtttttctccttcatgaaacaaatgacaagatgagattagatgcacaacagatttattggcagatatgcctgtgaaagataaacaggcaggaggttagaatagacagttttcagaccgtgctataggtctgaaacctgtaaaaggagagagggaagacaggattggatagaaaaagtctcagacaactatgccaaaattcttagccaggccaatggggattcctagagccacagcttttcattagaggaattttgtacaggaatggtcttgttctagcaaggctgccaagctcaatcactggctggaagcagcctatctgaagagcagcctgctgaacacagtggtgtatgcaaaggtgcagatgctagaggctgtccttcagttatgttcctagtagcagtttcagcagagcttcttcatagtcatcaaatatatgtattttgggcctttcagtgaagttgttgctaagaagatatggattttctttcttaattttcttagttaatatgttcaccctaataggccatgtcctataagtgtataagtgttattaggtaagagaatgaagatggattctgtggctgcatcataggctctgaatttaaaaagcaacaacaaaaaccttactaaatcaaatctcaaaacatatatcctgattgtggggcagtgtgggcttatagatgtttgcaaatgaataagcacatattctaatttgactcataatgctgttaagaaacaaattcataaatgtaagatagttattgcatttcaatgaggcatgccagcaatgttcaacaaaataggggaagaaacttataagcaagtatggaaaataatacagtcagtcagcaaggtacataggtttaataactgagttaagaatatccatatgacttatgtgtgcagtatacatatataaatatattcttttatatacattatcacaattcttttatatatattatatataatatataaatatatatataaattcttttatatatgtaatagaattgtgaaaatatatatgtgtgtatatatgtatatatgtgtatatatatgtatatatgtgtatgtgtgtgtgtgtgtgtgtatatatgtgtgtatatatatatatatatatatgaattgtgataatagtcccccagaaagtaaaattctgcaagcgggaaaagagtgacaaggcactcatactcagtgagctctggaaaggtgctcaacttactttacctgaattaatagatcataatttagcatttgatgtatagtctttgattctcaccaaaaaaatcagaaagattgcaagatctctcagtagttctagatgagaattcattgttatttttcgttatcattgatcagtaatatagatgaaagctcaataacgggttacagtgaatgttcattgaatgccaagcactgtgtttggtactgctgatacaaaggcaagtaaatcaagtgttacctcttcccttgttaattagttaaaattgcattcattcactccttaagcaaaaataatatatggttcccaattgcttttctgggcattggggatacaacagtaaataaatgttacagacaaaataaatgaatgaaaaaataaacaagtcccaaaatacaactggatagcagctgtggaatttttcttagtagatggaatcttttattccgtatttaacactattaaattccttaatagactacaccataaactctacaatatagagctcaacttgagatacagaatgtttaaaagagaataaaaacttctctgaagaattccattgtttaaagaaatggaaatcagcattattcaacatttcttactttatatatttaaaattatcttagttgctttttgtgatactacattattattttaataaaatatataaagttggatgatgataatataactcttcaaagatacttctgttagtggtttgatatatattttttcataatttttagtgagtaaatccatctacacatacatttttacataaatttaatttcatgcccattgtcactctttaaaatttaccttcttttaaaattactacaatatatgggcatatgctaatttactgataaatatgttgattgtcttccgttacttaataaacaattttaagaagaatctgtttttatatatatgaatctccataagagtatttatattttcttaggatagattcttagcaagggtacacttgatcaaaatttctacatattttaatttttgacatatattttcaaatggctattcaaaccttgtctaacagttttccagtttttcctctgctataggttgaattatgtcaccaacaaagatatgttgaaatccttacccccaggtacctatgaatgtgatttcaattggaaatagggtctttgaagatgtaatcatgtcaagatcagctcattagggtcggccctaatccaatataattgatttccttgtatatattattacattactttgtaccccataaatatattgaccaccatagttagtcaatttaaaatttaaaaataaatattaacgataatttaaaaataatttttaaaacagaagagggaaattggaacacaggcacacacacaaggagagcaccctgtgaagaacagacaaacagggagaacacaaggtaaaatggaggcagagattccattttcactgcaagccaatgagtagtagctggcaaaacaccagaaactatgagaaagatataaaacagatagaccgtggccctgcaggaaccttagtttggacttcttgcctccagacctgagaaaataaatgtctgtgttttaagccatcctagtttgtagtaatttgttaaggcagtccaggaaaactaaaacccacctctaacattttagagtgcttctttaccctcatagtcaccaaattgagcattctcactactttattactctgtctattagaaaagtaaaattacaaagatacctaatacatttaaaactaaatgaatctcattagataaaaggcagagaagtttcacatttgtcatatatatgcatgtttgtctatttaccaacatacttacctgttatcctttactttgttttataaaaggatttaagcagctattctctagttaatatagaaaaaaaatgctttaaaatggaaggaaaagaatcttccattaaagaaatagataggtgtcatcctcccagccaaataactgggctttgcgcggggtaggtatttaagtttatggctatagcagtatctggattgcagggttcaaatcatatgtttctattttctggctaacctcttatctctcagcttcagggtttggcatagacctaggatggcacagaatcatctaccatttctatgagatagaagcctgagaattcttgccattaacgttcagcctttctctcataggggtttgccgtgctgctgaaatacgcagttggtctagatggaaaatagctttctgacagtgtcaattcaaggatgttctgagtttattattaactctgggaattatatcataagaggcaaatactcctacaaaacattgatcaatgccactgttagagatacttggtcttaggttgatttgatcagaattacatttactatgttttaagtacaagaagagccctctgatgttcctcattgtggagttcttttcaaatagaatgcattgtaaatgtcatctcctgtgatgacaaggcagttgtagagtgtaaggcagtaaaggtgagatggaagaacaggggattggcagtcagaagcctgcattctagttgtggctttgctgcttactggctgtgggcctttggaatggtgagttgaacttctgtgttctcatcagtcaaatgggctttgaagtatacctcaaaaggtgattgtgaagatcaaatgtgaccatgtttatgcaagtattttggaaacatctagcgttaaatatatgtaaaatgttttcagttgcagaaattttagtttgaatcaagagtggtgggactttgaaacctctattctctcttttgtaaatatttttgtcatatttaatctaaagataaaaacaaaacactttataataactaaaggtttgtttatttggggctggctgtaagcaagagagtattatcactgagggttgttcatagccactcctgtagctcatccactgtttcaatcctacagtttccttcctttccgcgtaggctgtcttcacctggggtcacaagacgtcctcatgctcagcaccatgctttgttgaagcaccagggtggaaatattattatattttctgtggaaaaagtgagggaaattgagataaaaaggggaaaagttatttaaataagtatgttcatatctggtttataagccttaagataatttttatgaagagctatcttgttttactcagattatttttattttggttgactttggcacctatctgcagtattagtagcattgaagttgttattcagtggatgaaaccttgctgaagtggctgtgtggataccctaaaatagccacttctcccttgatgagtgtcgcattaagattccatggaagttcacaagggaaaaacaccttttctgtgttggcttttgttattgcacccctctatcccaattaacatttactgttttttacattggtaacttaattggctgctaaattttagaagataaactctgaatgtttatgactaaaattagaaatacttaaaaacattatttaaaacaaatgcaatgtaatgatgaaattcactgactgtatagtaaatatgttgccaaatatatagaaatgcccacaaaataatattttaaaaatattctaagtttactcttcatctgtattctaaatttgattccataatttgagatacaaaaattcatgattttaatataaaatctgaagagtaatattcatgaccatatacttacatatgatctctctaaatatatagtagtaatattaactattaataaactctataatgcaatacttcgtattaaagaggatgattgagtttaaatagctttgttcttacttatactttacttccttgggaaacaagtgaccttatatccaaaccctctgaagcaaagcattgaaataaaatgtttttaatgctgtgatgagaatttaaatgtcacagagtgctattgacatacatgtaagatcaaaagaggaagtgtgttatgacagataaatcaagatagtagaaaattctgttaaggtctaaactgaaagtatcataactaaaaacatgtagtggcattttcatgtattctgggcacacaaatcagctacaattggccaaaatgttacataatgaaagccagtaaataacatttttttcctcaaaaatagtagactgtggcattatacgtgacatttagaaaaggttcttattgtagctgtttctatcaatattcctataacaattgatttaaagattgtatttattttgtacttcaaacttccttcaactggtaaaatagaaactataaaagatcccctacctatgggtcaaattacttaccccaaatgattgagtaaatttgcaaccaagctgaaattagaacttttaattataatttaaaagatatttgaaattgaatggaaccaatcatagaaaattttatatttagctcctcaacacactaaagttccctttttgggccataggatcatagctgactgctatcttttagaaccttgctaccctgtgtgtggtccactgagcagcagcatcaacatccatgcagaaatacagaatctcaggctctagcccatacttactgaatcagtttgccttctaacaagatcctcagtgatttatatgcccattggaattggagaagcacgatttcaaacatcattatatatttcctcagttttttttcttacaggcaataggtgtgaactacttactaaggtggactgcaataaaaaatattaactttgtcataaaatgtcgaatattcattagtgtatttatacatgtatgagtctgagaaagccagactccaaagagtgaactatgcaatacgtattttatttttttctaataaggtattgatttttgttacagataaagatttaaaactatccaaatactgcattaaagtggcaaagtgcttatgagaaagaagatatcagagctgaatttctacttttatcaccattgagggatacagcattctcaaatgcatccagtatcattatctgactagaaaattcttgctcaaatcattgttcaacagaatactgtttagatcttatttacagtttccaattggactttaggcaagaagctcttgtaggctttaaattccacacaaaggcacaatcacataatcatgactcttcttcctcaaatattttacatgcttcctcataaaaagtagagctcttcaaaaggttaggcctatctccctaccagtattggattgagtgtacagacaaaaacatacctcaaatatgtttggtaaagatcagaaaaaaactctaatttttcattttacaatgtagacttgtcacaaagaataaagaataagagaatagctggaagcagtacctctttcaaagcgtaggagggcaggctgtcagcaaaccaatgggactatgacgaaaggccagcatccactgtcttttagtttgtggaaaccatttattattttaaaaaattataccattaataaacttagaggcatggtatctgtcatcattactgatttgtatgcatgaaaaaacctcctgaccttttcttttttaaattttataactcatgtgaattcggtttccttaaggacttgttaaacagtactatggctttcttggtcatcctgaatgctaattttcttcaggtaattcggttcgtgaagactgaaagtcattatttgtttatgacctaatgtcattcattagttctgtttcattaaaaaaatggatattactgaagaaatatgtttatcaaagaaaagattcaaggtgggctttattatcttcaagcatgtggtctattaagcaaaataagatattcagcaaaagactatgataaatcagtttctctttattgaagaagctactttgacatttccattccagctcagtctaagtctgcatgacaaacaactgtttcttgctagcttctgtattaatgtttaaactctctttggtaatcaggacttttaaacattttttataatgatttggatagaaatagtcaaatttataattacatttgtgacagaaaggtgaaccttctaacagtagtatttttaaacatatctctatactgaagcaaaaagaacaacctagcatcctttgccttatcatcttctattctataaaatatgaaaatgggataaaagtgaagtatacactgtgttttcaccctacgcttgaattaagaattgctttctttccttcatattagagtaagttaaaattagaacactttttatttaaattgtcaggtaaaatgtgttgctttcaaaatatgctttctttttagtaaaataaagatccacctttctttcttatattaaaatgcaaagaaatgtatattttagagtaacatatgcatttattatttgcaggggtcatacagaatagaggtaggctaccagagtgcttctccagagctgatcaagcacgttagcatttgtaaagttcttttttttgtcaggagaaccaaaaagacatacttccaaaattaaaatgtaaatcatatgttcaaaactaaaatgaattaatgagttaagtcttacaatacctgttggaaacactttccacaagacttttgtgatcttttatttgatgggccatgagcaaccagaaatgagtatgtttttagattcctggactgccatgcttcaaatatattgatgtatcttactttacatctctttctctaagaggattattcagttaccacttttgagcttaaaaaaaatagactttaatgttgtattccagataaattcttttaaaattctggtatcaacttttaaaatattatcttctgaattatccactggatttttctccctggaggctcactttagagatgttcacacacaactgctggtttgctttagataaagcacttgttctcacgttctcatgtaagttttatcacaaacaatgtctaacttcacttttatcatttcgcttcttaattcctttctctttgtcacaagtcctgtgctttgtagctgttttccttatttttgtttttaatgtggcttacctttgcagttaaaattcttagaaattattgttactttgaatttcaaatcagaggaattaatttttttaaagtctataatgcaaacaaattattatgatattgaatacactaaaaatctgaagcatttttccagtttaaatgataattataatataaacaaatacactcttataaaatgtgagtaaaattaatattaagagagaatttgaatagcttcaatattaactctaatattatttcatatacaaacgttttacaatttatttccaggatcagaaaaggaaccatataaaataccacaaaaaaaaatataggctttgcctgaagtgttataagtaaaatttagaaatgttcataaagattataaagtttcttctcaatttgtttaagttcagaaacgtcattaaaatgtttatatttgctcacctttttggtaggcacaggctaattcaagataaaataatgtaatgtttttctgggtgctatgaccccacataaacagtcctgaagacaaataatgtcattcaggatgctaagtgcttacctagatacaggacatgatagggacagatcccccacctgaactgaagcaagtcaaagaggacttgaggctaacctgagacttggaagatgaagagttccctggcagacaggaggaaagaaagacaagactaatggggagtgttgtagggaaagaaactggcttatccaaagtcatggggacacataacagcacagacacataaactgtcagtattttagtttggtctacgtctagggacttaaagatcaaaccaacatctttaactataccaagaatataatatagtccaaacaacggcccataaatgttctaggtatgtgggagtttttatggcagtcttcattaatcccatgttatgaaaaagaattatttctgatgttcctgacaaatcagcagagttgcaagtgaaggaaggaaagtggaagaagtttggaaataaatgaccgtgatttaatatggaagaatcacagcaagagaaccctgatattttggttctaactccagtttagtttataaacctgcttcgtattctaaacaagtcatcactgaccctatattttctaaatacaggataatgtttggcctaaatatgttgtttgtgttttaacaaaactctgttagtcaagagacaaaaacacagtgtcattgttggaaatgctgaaagaaatcttgaaattcaacctccttcatcctatagcttcctccacttccaccttctacctgcttccccttctatcttccttttcctgtttctacattttctaccttcctatgttagctcctgagcgtctatgaataaacctaaagcttcataaaatactgtggaaattagtgtccagataacttcttatgttctttcagaccatatttctccatctctgaatggtgtttaattaataatcaattaatagtcaaagggaaaaggggaaatctgagggcctgtgataataaataataaatatagttaggttaattggtggaatctaatgaagaggaaaggtatactataatgaaagaaggcaataaataaaatctggaactaaaatagtaattgtaaatactatctatgaattccttagtgtcagatattttaaatatttagtcttgtttaaatttccaaccatcctggagtagctatactgtttcctgtttatacagaaaagtacatgagttaaacaggttaaaagaatagtttcttatggactccactgacaacctatggagagacaatgcttttgtactgggcccttataggtgttgagcttaatcttcagagcctcctgtcctggggtggggggaggggggagggatagcattaggtgaaatacctaatgtaaatgaccagttaatgggtgcagcacaccaacatggcacatgtatacatatgtaacaaacctgcatgttgtgcacacgtacccaagaacttaaagaataataataaaacaaagcaaaacaaaacaaataacaaccacaaccacaacaaaaggtttaaagtaagcatattcccattttatagctaaaaacctgagattccaaaaggttaaattaattgctcaacctgaggccatctggctcctcttccagtgcccattcctctacatactttattgcttccttaatctccacaggaatcatttccccttttctatcagccttcaaaagcttgttgattgctctctaattacaaatacttggagaaaagtgtgtaaattgatatgcaaatgatcttttccccttagcaaattagcactttacttccatctaattaagtagctttgtgaaggaaatggatttctgaaagaagaatggaaagtgtttggatttgttctgggggtgtttctggtttagcaagccttgtaaatgaggtatataaaaaggagtcaagagtaggagcaaacaatgaaagcagagaaaaaacgaagggggttggatgaaaaaatttaagtataatgactgacaaaccttcaggagaaagtaaactgcctttcatctttcattctttctccaataataacacttttttttaaagtaaaataaaactttaagaaagttctgatttctctcagacatcggtgttaacgctgacaatatatttatcaaaaatggatatattcaagcctaaactactaatttttgttgtatctagaatttacaggacattctcttaattgggaagaaattaattccttgagtatgttacaagaattttccttaggaaagagtcacttgttgcaataggaattaagatatggctttgccattatatatatttagtggaattaggggcaagacatgtatgtactagcttcttccataataggactgaagcagttgcctgaatgttatctttaattattgccagtgaatagtaattcggtactgaatatgtactgaattgaacatgtaactacctgaagtaaaaggtgtcaatttaaatttttcattgaaaatatggcaactgagattcacaataatatattaaatctttatcctctagcaatctgtttttatgaatttaacaaaatgtctgtatgtaagcagtttagttgtatgtgcttggggaaagcctttagtctttattaaattatactacccaggtccataaatagctagttcctataagttacacaatgccatattaagttatattagccattcttcttaataatgaaaacatatttaataataaaatattatttacccttctacctatgtttctttgccaggtattatactcttgtctataccaccaaattattttttggatttacaatgtttatttttatattttattcattaaaatgtaataaaaaataattgaaaactgatgctaattgaataccttaggaaggatcaactctgctgttggcaatttcacttatcttattctagttgccctttaagaaaaataaagagaaatcatattggctgttttccaggagattataacacattggagaagggagaatctttgtagcaaaaaataactagaaaaccattgggtgccagatacaaattatgatgtaaattataagaaccattttattataaacacttctatggaaaaagtgacaaatatcacatatcagagaaaaggtcagacattcagatcttaatttgtatacaaaaaatctttttactgttactgaatactgatatcccaagagtaattgaagaagtatgcaagtactataaattgcctccaagctacaatattcttttgaaggagaaaagattaaaagattataaattccatattcccaaccaccatcatccctccattatctagactgtgtcccttccagtgtattgtgaaaaatcttcgagagatcatgctgccaatatgtcaaggattctacttttttgtaacaggtgagggcctttgatatcaaacagttcaccacctttattcttacaggaagacactgaggcccagagaggtcacttgggtttgtcctgttgtgttcttagaggtgaagatttgataccaaatctgacatgtgatcctcaaccaagcaagggtttcaaccttgacttggtatcttcatgctctgaatagtcatcactttattgtgcaatttatctaataacacaattgtgtctgtaaagaaaatacaaatggagaaaagtttctgcaattattaagcagaatataaacctaaggatatataaagcatatatttatctcaatatttccatcttctctttctcaaatccaaggttttcttactctactttcaaagaacaatatatatgatgttttaaatttgaatataaagaagccatttaaatgtattttctgaaatgtgcaacaggctgcaagggttttttttttttttttttttttttttttttttttttttgatgaatacataattgtcctaggcatttttaatttgttgcatggcagatttcctgaatcaaatagcagctgtttggggaaagtagcaagcacattttctgcaggcccattggttgctgttttgctttcatattctctcaccattaactatacagcagctagagcagaggagttgttaacaaaatatactttcactgctagccaaactatatacatgacttagtggtaatatttgattttatgtcatttacttatgtctctgtatgtcttacaccaagggactaacacccaatgggagaaagaaaaaaagggaaaattaactaagtatctgtgaaccatcaaataggctcagataaaataatgagccttcaacaagctggaatataataacattaggactttggagttcagtgggcagttagatgcactaatggcactgctgtgctgggaaaacatatattttatttggaatttttgtgtggaggtgattgcacattatatgaatagctgtgctaaatgcatgaaggttttctgccagcataggaggcgattaaggccccctctgccagataacagctcactggagggaagtaatggtggcaaagtaaaatctgaaaacagatgatttcccatttaatagtccattgactctcctcctacagccactgtggtgatggtgctgctctttattttcatttcacaaagaagcacaaggtattctgagattttttaggtcatacattttctttcaaaaagaaagagagagaaaaaagatgagagagaaagagaaaaggagagaaaaaacaccaagtattgcattaaagaaaaatgcaattgattcactcattcattttaagaaaaaaagatacttatttttgtgtttattgaatgttcattgtagttcaggatgatttcgtttttttttctttctcccctgcaccccctcgtttgtgtcactcatcctctagggagctgtatcaaacttacaaaaaagggtactgcattttgaatgtatatccaacatgattatgagacagacccagcccacactgtcagaaaaaaataaaaaatgtgtttgtccgttcaaactgtgatttggatataaaatagccaatatacttttaccatttaaaacattttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgccagatatgcattattttgatgtctaggttccttcatcttaaaaatacagttcatgccaagttttgggagattgatcattaagcaagctggcgattaagcatagcaacactgaatgtatggatgtaaccattcagataggtggttctatctaatatgtccatttgttttttagaatgataaatttttaataatttttacaattcctttaatcaggcagcttcttctataggtactcaggacagtttagtttattgattgttgcttcactttttgctgtcagaacttgtggatgtctcttttctattctaaaaggcagtttttacagcaacaaatagcatgcaagtaaactataaaaatgtattcagcaaggtagggtgactcagcctgcaatcccaacattttgggaggccgagatgggcagatcacttgaacccaggagttcgaaaccagactgggcaacatagagagactctgttctctacaaaaataaaaataaaaattagctgggagtggtggtgtgttcctgtagtcccagctacttgggaggctgagatgggaggatcacctgagcccagggaggtagaggctacaatgagccatgattgtacccctgcactccagggatacataataccctgcagtgcactccaagtgcaccctgcagcctgggcaacagagtaagatcttgtctgaaaaatacataaataaataataaatatgtttttatttttactgcatattctcttctttaataagttgttctacatttcatttttctttattacctcttttaaaactataccactttctctggtctttctgttgtttgcatttcatgcctttgacttttcttaaccctatggaattctgacatacttacatggaacacatatattatttaattcactacatgtatatatcatttattttacttgcctttaagaaattacttctcacaaaaaaaagaaattacttcttaatttcaatatgtttcatgcttttcaaggaactcaatattttcacttaggcctttttttccgatttatttttgtaagaaagttaaatctatgtcaactctaaaaatactttaatccatttgtgctttaataacctcattaaagggggaaggagtaatgaagtgatgtttctacttcattaaatatactagtagtgagaactacatatggtggttttataattgttattattcacaactacatcctgaacatttctgaaagatttatagtgattagcaatattcttcttttcaagagagaaaaattatggtatgaagagattagtaattacctaaagattttattggttacttataccaggagtaggctagaactgatatctactaaatctttctattaggtagtccattaaaaacaaacaaacaacaacaaaaaaatttctgtaatttgaccttatagtgctatattgaattgtactaattatgatggctttatcttcctttgactttcagatccaagtaatacctgtgcatttgaatctacatgatctaattgtgtttatacttacgtctttcacaatttttactactattgaggttgtttgtataaatacggtaaatagatctgataacaactcatagctcaggaatttatatatggtgttaatgagcacaagattagtgattcaaactacattttagttccattttataaggcttcaccttcttctcaaccagacagtgtatctggactgtatacaaagagggatggatgccaactgtgaaacccagttttgaaatgtgtttttgttaggcaagatgaggaccaaaggaataaaatattatgagatggtggggaggagataaatgtctaattcctagtctaaggaaatatgtaagatggtggaaccagagtcagaatccaaggaagtctggggccaaagctgacagaagaaacaaataagatgcaaaagcaaaggatttaagatgtgatcagcatggaataatctgggagaggatgctgtcatttttactgccagtccttttaagggtccaatccttcttatcagggatacatctgcccattttaaaaacatcatatttagaaattgcattctgataccagacatcttatagaaagttgtgcttagtcatgcctggagtaggtgagacagaaagaatgagtagttagagtccatgctcacttttagaaaaaagaattcaaagcatatgcactactttgagtgagtcagtattgtcgtcttcaaatgcaaaggataacaagtaatttctccatggccagggttgataaaaagtgactcatgtcaaagatttatcttttttttctccaggcatagtgtttcacaaaaaataaatctatataaactgcaaaagtaaaatgttcatatatggacaactaaaagacagtgtttatccattccattatagacattgtacaactatgagtcatagtggcaaaatgacaagttttccactgtagcatctaagatttaaaaataaaagaaaattagaaatctcaaaaataatagtagattgcaaaataccttgcaacattttttgagtcagccaattactagaaactggaacatatgtttatctgagaaatacctttcagctgccttcctccatggctgtaagatacattttgcactacactgcaatacctataattataggactataattttaggattggaaggaaccttattgatcagttagttaatcccttcttttcacagctgaagaatctaacaactaaactggttaatgaataaatagtaagtgaagtctaataaaacatgtttgaaggctaatagcatctatataataaagactaaatagatacacattcaaaatatgacttcactgttgggcaacataagacagctagtggagaatttagatttctctctttctaactgattgtcatgtcttatggaggaaattctcaaagataatgttaacatatgttgggataaaccctttctgctttacctcttcttgttatctttttcttattttagattgtgtagtgttacagatatatttgtataaccagtggtatattttatgtactctatgaaatttctcttctctcaagaaagttgtagactagccatatttatcttaggttgaagatcatatgttctgttttgccctggacatttctggttgtcatagggtagtagttaataataccctctttcacttttcaaaatacctcagtttgaatgataagttatatgtccacccttgccttaggtatagtctttataaaaaaaaaaatttaacttttattttagattcagggggtacatggacaggtttgttatatgggaatattgtgtgatgctaaggtgtggagtttacgttatcccatcacccagatagtaaacatagtatccaataggtagtttttcagcccttgtgtccctccctctcttccccttctggtagtttcctgtatcgatcgtgcccatttttatgcccacgtgtacccaatgcttaactcccacttataagtgagaacatgtggtactcggttttctgtttttgagtaaatttgcttaggataatgacctctagctgcatcctgttgctccaaaggacatgattttgtcctttttcatggctatctaggattccatggtgtacatgtaacacattttgtttactccatccactattgatagacacctatgtacagtctttattcactatttaaaatagatttatgggattcatcaactgtgcataagagcatttgggtaggtgaggaggcattaatgaaagatggtccagacacaattccaatatttagaaattggtatctggttggggagagaataaatactttaaatgattaagacaacacctaattcagtgacagaataagtgatatgcctgaaaaatctaagagttctgagaaataggaggtttgagggctgaaatgatgagcattttccatcttctctccactctgtttaacatttccttaccccatgggtatctcactgaaggactcctgtgacctgaacctgccttttctgtctctttttcactttattgctctctgtaagttagtgtgtctgctatgttcccattgcctccaacattaaactctcataaaagttttattttcttttactttgtgaattcaataaatctactagttactttgccacagtgatccgggcttatggctttacacgggtaataatcattcatatattaagtggctgcccttatactcagcaaatctgttccttcaaagtgaacttttgcagctattgatttctttccctagttcttgtaccttttaccaaaaagttggatttcccaagagcaacaccattgggaaaacattttagtaattgattgcgatatattttgaaggctatgtgatcttagttctgtgggattccaaaaatgttaattatagagtcctctctattgtaatttctgaagtatcttctctaaactacctccactgaatctgaattcacattgtcttatagtagaagaagatattattcaaatgtttaggaaatttctcaggaaacgataatttaaccatctgtatttgccttgtatatctgtgggacaatagacacattgatttagtatttttcactgttttttgtatagaagacatttttcttttatgttcttgagtaaatcatctcagaaaagatgtaatatttttatgttacaggtagcatcaccataagaatggctcactgattagttttgacttaaatacatgtttaccttagctatgctaagattaagtgtacaattttaatcttcaatatctgtaggcttccaggtttctggacagaattcaagagagtatcattttgtactggtcactgacagtccaaagactgtcgttaactctgatgtttttcaaatgacatattgtgttcacctgaatgtttgacccaacaaggaaaatgaatatttattccatacatccttaaagaagggaatttttcttttgcttttcataatgtaaattacatgatgattgcataaagttttcattgagattagtttataacaatttttttctataaatttaattaataaaaatatctaaatcttaaagtcaaacaattaattttaaatacagccattgacttttcaggacttttaaaacctcataaagattaaaaactgcacttatatatataacagtgctaagataggtcttaggtaattgtaattttctctttataggagatttgaagaataatcttcctatgttggataacgctttatgcaaacagtgtccagagaaaagatataatcctcattaaaagtggttgtgcttgcttagcctctatgtttaatagaaaatcaagacttgctagtgcaaagatagtgtctgttgattcagaagattatagcagtgattttccagaagctaatgaaaggtactaaaatgaattgataatctaactggtgcattttaaaacgcttaaagagaacttaatatataatgtcttcatgaattgcttctagttctgttttaataataaactcgtaactcagatatgcatacaaacaggaatcaattgggacagcaatgagcataaacatttataatcacttgcttttataggaactaaacctatgacagttatatcgatgattagagtacctacacatgaagacaggtagaaagtagaacatacatccaaagtaacatactgtcaaaaatatccaagcaatgattgcatatttgaacaatgtatattaaaagattataaaattatgtgagcagtatgtatttttagcattttatatgcacaactatcttctgtttggtcaaattacgtgtcttttatacacgctaaaaactgaaaacaacatggacaatgcaaaagaataagtttatgtttctaaataaaaacctgtacttgttaatcattttgttttttataacatctccacaacataggaatcaagtcatgaaagcagacaaagtgatactatattctgaagttattatgctgttggcctgactgacatctgtagacataaactctctacctgtttgaaagtattacagatattaatttttaacaatatttgccctaacttgcatttttctctttgtttttagtatctgacattttatatgtctcagattaaatattattttgtggtggtaaaatgtaaacattatttttatgaattcattctcatatatatacaatcacttaaatatgtattgaataccaggaaataagctatatttaacaagtgaacacattaatttcccaggatatgtttattgaaccttatgagactattaattctgatttatgtgctccttatgtttgatacacagaaataggcaaccctttggagaacaaaaaattagaagaaaatagatgctataattcatatttcaagtagtactgtccccagtaatacagagctagtgaaaatagcgcaggatgcttgatactggagtgtactttaaacaataaattattggagggcatagaaacctcatcaagacagcaagtctgcaaagactccatgtgggcaacctggccttgctctcctgtgctgctggtcaacttcctacagctcagctggcattgctcaccagacaagtacatgataggcatatcacttgttgtacattatctttcaactttttatcttttaataattttctggctcattgttacatttcctgtgagaaaaatggagttatttgaaagtttagtttcagtggtttttcttgtggctataattagggtgcagtccacttcccattgatctgtgcacagaatacaaaatacataagagaagaggtgataatgtgaagtgagaagttaaggggaaaatggccatgcggcttctattatagaaatgagggcttaaacacatacaatgacatagcctatatataattgagagttatctatgtgcatgagaagcaatgtgtatgtatgcatatatattagcggtgggaactgtacacaggctaatgtttagcacaaaaaatgataaaataattatttttattaattaaatgcatcaaagcctaattaaggaatgactcatgtgcagatgattatgaataaattgccaaatagaacctgtccaaatgcagaaaaaattgattttaaaataattcatataattattttattgagataatcaaaaatatctaatttgaaagcaaaatgaagatatttgaaataatttggttaacttatcacatataattattttattgaggtaatagcaagtatttaatttggaagcaaaatgaagacatttgaaactagtttggttaacttatcacagctatggtataatttgagtcagaaaactgacatcaactaagtaacaatagtatatcaaaccattgagtatatactatgtgctaaataaaacatgtatgttatgtcattaaattctatcagtaacactgcatggtagatacttgcatttccgtttgatacaagagaaaacacaacttacccacatcacagtagagtgccacagccaaaatttgcagctgtatctctgacatcgtgacatttattttaaaaagagaaaatgaaattagttatttatttaacttaatagagtggttgaaagcatgggctctaaagaaaaccagatggttttaaattctgacaggcactcatatactagctgtgtagtcttggttacttaccttattggagcctggattatctaatttataacatggagataacaatacacagagtaagcactcagtgttgttattattaagatatacatgttgccttaattgactgaaatatctatgacaagtgtaattctgttgatatttatctggatattttaaggtatgttttatttgtcttccaatcaggaacatggtaaccataacctgcccaaccccaaactaataactgaggctataaaaagtaagagtcacttaccatttcattctatgcagtttcctgccttgaaataggtgtcttatggctttggttggcaatactgttaatggaatatagttgtattaaaagcaatttttttttgacaattctttgttagcagtcagcaactaaatatattaagaagccttgttttgcacactcttccaaccacagaacactaaagatgtatatgttataattacaattatcctttctcttcattgtcctgctgaggaatgcactgtaattctggcagctagagtagagttggcttgctttccttggattgcagatgtctaattgcaggcaaccatttcatttaaaatggctcattaaagtaaaaaccatttagcatcagtaacatggatcagcatccatgattatgcatttaattagagagaagtatgttttctcctcttttctaatttttctatctatagatctacctatgtatcaatctatgcatctacccacacacatacacatagatgcacacatgcagatttatacaaagcttgccttagacattaattttatcattttgccatcattgcaactccttggctaattgttccatggagtatgtatagaacgtactaattatgaaattatagaatatattgttactcaatattagtaaattgcatattgcacatataggaattttctgttttgtaggcttttctagatatgttatattttaccttagtaaatgtccttatttactaactgaaatattacttgtttattatcattccaaagaagcgtcatatcctgaacgctttagtttactgatcactgaaataagaccgtggtgtgggaagagagagagagagagagaattccaatttttctcattctcatgcataaaagatcaatcatagaagcatagttttgatgtgatgatatgtcctgttatttgtattgtgaaaatagatttgtctaacaatatttgttcggaaatagaacatttggactttttaagcattacttttaacaatatttttaaaaatagtcaaaaaccacaggcattatctatatcataattctactaaacagcagtgatgagtggcaattagttgtttattgagtcactgtttacataattatttgtaagttatttgtaaatggccttaggttttttagatctataaatttcagtgaataaaatataatttaaaggctttcataatattaaataagaatgaaccaggctgtcttttattagcttatttttcatttcattagagaaaaacacagtttactttggcagaatctagatatgttgatgtactttatcatgtccaaattcgaggcagtaaataattttctgtagagagcccctagtccttaaagagtagactaaatcaacaaaggatccagaagtaaaagtcagaagctaaagtatatttgtgcatttctgtgtcagtaagaaagaagttaagactgagatataaattaagaatacattatataaaacctgctccagtcctgtcctgtaagacagccaggggatagcctcaagagttcaaggttaatgggtctctatgggaagtatttactttctcactggatttttaaattacattcccttttttccccaccagtactactgaagtaaaaagagaaacaaatgaacaaaaacagtgctggcaggtatgctatttattgcccaatggaaaagttataaaatcattgttattactgctgtataataattgatacatactgcttgatatgtgccattgttttatgctggtcacctttcacccttttttgtttttttttgtcacattcttgatatagatcataagcaagaaaagagacaagtgaaagtggaaggggaggaaatagagaaaagataaagagataatagagaaaagaaagagagaggaacttcaagaagagagaaacatacttcacagctgggcaagattcagatttttttttaaaaatgagaggatcaaccatgatttgagagaataaggatacaaagttagtgtttaaaaagagtgaagagagaggggaaagagttgttttgagtttgaagtgttagtaaactatgcttctcacacactgcgatttacttgaatgttagtcgtcaaagtgatatcaaatcttatcactgcattgaaatgcaaaatagatgattgattactattcatagttcttcaactttctttctaagcaaattttcaagtacttctatgcagttgcagtccaagtagctaagtcttagaaattatctgagcagtgaagaaagtattactcatctttaggaaggaatacatttaaactgaaagtgaaattgtgtctctttgatcaatggacaattccaccctaacccagttgctaaagaaactgttttgatgcctttatttttcatgcctgccctcagttactctattgtttttatgctgagtgctacaaagggaacgaccatcaaaatctctttgtactaagaactttaggaaggagtgaaaataatgtataaacaaagcttctgccctagttcattataattgggaaaataaggtaaatgcgattatacaatttcaaagactatataatgaaatagagtgtaagttttagaataaaaacctggagaatcaaatgacaaaaacatttgcacatagggtttcttttagggagtttggaggcaaataacctataccatacctattatataaggcacagaatagataatagtgtttaaataaaaagctataaattgttactcttatacagatataaaaatgaacacattttaaatgttttatttaactcacatgggaaccaggaaaatgttgtaatctattcaaaaaagaatctaaggaacagacacatgtatagactaggaatatgcaaatggcatcaaaatattttccacaaaaaagagtatgaaagtcacttaaaacctctaacagacaagacagaattcataggtatgtcagttacctacaatttacagaatcttaaactgtatcccatagaaccataatcttggcctgccaagaccaagagtgctataaataatacatagttttcctaggaattacaaatcttttctcaaaaatagtaagggcaaaaacctagagaaccataataacactcatttcatcattttcaaatgagtagtgaacagcgtatcttgaacattacaaaagatagaaatcctaaacacaaaaattattatataatacatttgtcagttctttgtgtttatatgcacacacacacacaccttttttttcctagtgtgataattgctttatattttggttattccttttacatcaaacttaatatttcacataatctaatcaattgatctagtcctttgggatgatgtcttgtctttgttctacagatgagacaatcaacttcctatttggattttaaagaaatacgtaagggtttgattaatgatagagttcctgggtagaggaaatgatatttttaaaaaattaattagattatatttttaggaaacattactttattgagatttttacattaagtgataacaatcatattttttttagttttcaaaagagaaaagacttggttgttttctactactattttaagggttagttttttcatcaaagcaatatatatctttatttcatggttcatttttataaaactcgattacaaataatgcgctgtggaatttttcccaaggcaaaagatcaaatatagagaactggccaaatatttatactttgcctctgtgttttcattaatggaatttttattagaacttaatatttgtttatttttgcattttggaaagaagcgtgtctaaatccaaacctttctcttacattacccttttaaaaagccaagtaaatctgagcattcactttcctgctcaaaaccttgcaatcatctcctttactgaagtccaccagcctctgcttgatctgccctatgcagactcatcctccctatctcctcaccccactccttgctttcttcttggcttgcaaacagctgcctcttgctgggttctcccatactggagagaaagagagagcaaggtctctagaattgcctcttatgaggataataatcctatcatgagagtcccactctcaggatcatatataataaatcaaatgactttccaaagtccctaactctacatactaccacattgggaaattaaggcttcaacatatgaattttgagaagactcaagtcagtcaatagcattctgcccctgacaccccaaaattcatgtcctcacatacaaaatacgttcatttcacccaaatacccaaagtattaacttgttccagcagcaactctaaagttcagagtctcatctaaatactatctaaatcagatatgggtgagactcaaagtattactctttcctgagaaaaatttcctttttatatgaacctgtgaagtcagacaaattatatgctttcagaatacaatggtggaacaggtataggataaacatccccattccaaatagaaaaatagaaaagaataaaggggtgggagtcccaaacaagcccaaatcctaacaaggcaaatttaggcctccttcattctgtcttttttactatgttccttttagttcaaaactggcagtgttgctggcataatcctgtctttattcctggactctgctggaatggctgattaacttcatcacagtcattcatgatttctttattaaagttttagccacatctttaatgttctcttcagaacaagctttctctctctctctggtaatatgaataggctgagaattttccaaatcttcaaggtctggttcttttttgcttgacaaattcctgatttaattcctctttcttttttttttttttttttttttttgtattttattataagcagtcaggaggaatcaaattagctgcttcttcaatactttgcttagaaatctcctcagctaattatctagtttcattgttcgtagtccttccttccacaagacactaaaacatagttcagccaaatcccttgctaatttgtaacaagaatcacatttcctccagtttctgatatgtcctcatttccatctgacacatcaccagaattgcccttaacactcatatttttatgtttctttaaaatttgttttaacttcctattatcaccacttaattaatgcccatatttttagtatgcacttcaaattcctacagcctccacccactactgagttccaaagctgcttccacatatgcaggtatttgttacagcagcaccacactcttgttaccaaaatctgtattagtcaaagttccccaaagaaacagtaccaacagataatatagtacaagaaactgactcaagcaattatggagactaagaagttccaagatctgaagttggtatgctggagacccagaagagttaatgttatagttccagtctaaaagccagcagactcaaaacctaaaaagagacaatattgtagcttgagtcagaaagcaggaaaacattaatgtctaacctcagggcagtcaggcaggagaagttctctgttcagcacatgagggtcagccctttttctctatccaggccttcaaatgattggataaggcccacctataatacattagggaggacaattactcagtccactaattcaagtgttaatctcatataaagacatacccacagacacaccaagaatcatgtttgtcaaagtatttgggtacccatgaccctgtcaagttgacacatataattaaccatcacagggagcctagaggtaaagaccttgggtggggggaattatagaaagaggctggagcagatcctacagggccctgaaggacacattaaagaattgggaacttgtcctaaggaaaatgacaacccattggtgatttttaaggaggtaaataaggtaatctgattactattattattttttaaaaggacatgaggaagtttgggttgttgagaggaaaggcagagagaaaggtggtactgtagttagaaattgtggtttgatctcaacttgtcttcatggagaagaaagtggagttccagcttgatccagcttgtcttcattgagaatgggagagttttgaaatatagtgagagattgatttgatatgaggagagaataaaagggagggatcaataatggtggccagtggctagatttagcaaatatatttgtagtgtgtgatttaccacaaatgaagaaagaaggaagttttataggaagaggatgactttagttttaggtttatgaagtttaagtggtgcaggtctgaggtccagaggtgtagtctgggatagacttacatgttgtaacaggccaagatttcctaggtagagaatgtaaaaaatgtagcgataaaggatctgatgaaaaggcacccagtatttgatggatagaggaagggaagccctggaggtaccatcaacttttttttggctcctattgtattcaatatgttgacatttatacaatatctcagaaataacagggtttagaaaacatactgtattagtccgctttcaggctgctgataaaggcatatccaaaagtgggcaatttacaaaagaaagaagtgtaatggacttacagctctgcatggctggagaggcctcacaatcatggcagaaggcaaggaggagcaagtcacatcttaggtggatggcagcaggcagagagagagagcttgtgtagggaaacttccatttttaaaaacatcagacctcgtgagacttattcactatcatgaaaacaatatgtgaaagacccatccctattattcagttatctcccaccagattcctcctataacacatgggaattatgagagctataagatgagatttgagtgaggacacagagccaaaccatatcattcctccccaggcccctcctaaatctcatgccctcacatttcaaaaccaatcatgccttcccaacagtccctcaaagtcttaactcatttcagcactaactcaaaagttcacaatcgaaagtctcatctgagataaggcaagttctttaggcctatgagcctgtaacatcaaaagcaagtttgttacttcatagataaaatggtggtacaggcattgggtaaatacagtcattccaaaagggagaaatcggcccaaaacaaaggggctacaggccccatgcaagtccaaaatctggtggggcagtcaaagctccaaaatgatctttttttactccatgtctcacatccaggtcatgttgatgtaagatgtgggttcccatggtcttaggtagctctgcccctgtggctttgcagagtacagcctccctcatgactgctttcatgggctggtgttgaatgtctgcagcttttctaagtgcacagtacaaactgtcagtggatctatcattctggggtctggaggatggtggcccttttctcacagctccactaggcagtgccccagtaggggctctgtgtggatgttccgacccaacatctccctttcacactgccctagcagagtttctccacgagggccccatccctgcagcaaacttctgcttgggcatccaggtgtttccatacatcttctgaaatctaggcagaggttcccaaaccgcatttcctgacttctgtgcactcacaggcttaacaccacatggaagctgccaaggcttggggcttgcaccctctgaagccacagcctgagctctacattggcccctttcagccgtggctagagcagctgggatgcagggcacaatgtccctagactacacacagcatggggaccctgggcccggcccacaaaaccagtttttcttcctaggcctctgggcctgtgatgggagggactgctgcaaagacctctgacatgccctggaaacattttccccattgtcttggggattaatattcagctccttgttacttattcaaatttctgtagtcagcttgaatttatgctcagaatatggaattttcttttctattgcattgtcagactggctgcaaatttttcagacttttatgctctgcttcccttattaacagcaccccagtcacctcttgaatgctttgctgcttagaaatgtcttccaccagataccctaaatcatctctctcaagttcaaagttccacatatctttaggtcaggggcaaaatgccaccagtctctttgctaaaagaatcaccttttctccagttcccaacaagttccttatctccacccgagaccacctcagccttgatttcattgtccatatcattatcaggattttggttaaagccattcaacaagtctctagggagttccaaactttcccacattttcctgtcttcttctgagccctccaatctgttccaccctctgtctgttaccaagttccaaagttgcttccacattttcagtattttttcagcagcaccccactctactagttccaatttacagtattagtttgttttcatgttgctgataaagacatacctaaggctggtcaatttacaaaagaaagaagtgtaatggacttatagttccacatggctggggagcctcacaatcatggcagaaggcaaggaggagcaaatcatatcttatgtggatggtggcaggcaaaaagagagagcttgtgtagggaaacttaatttttgaagtcatcagatcttatgagacctattcactatcacaagaacagcaggagagagactcgccccaatgatttgatgatctctcaccaggtccctccacaacatgtggcaattatgggagctacaagatgagatttgggtggggacacagatccaaacaatatcacatggtatcatggtgaaaaatgtaatgaaaccatgactacatttgatctttaggtttgcactatgttttaatgagcgtttcaacttttattgcttttatgttgatttttacatctgtctacaaagtgattttttataggcttttggtttttttggctgtagatgtgaaagagaatggtgcattgtgaaagaaaaggttgaacaaaaatcaattcatgtcagaattgattaaaatcaggaaacattttcaatgtcaacaggatatttaggatgagaataattaaatgagctctggaggcaaatgaattattgactacttacaaatatcaggcctaagaagatagagattgagacatatgtcttcttttttttcttagtgaagagaaacagacaaaactcttctaatatgtaacttggtattaaaccattgtgaggaataattaggaaattatcctaacataggaaaaaatatacaattgacacattaaatgtcaattgtaattgacaattgtcaaatgtcaattgtaattgacaattgtcaaatgtcaattgtaattgacaattgtcaaatgtcaattgtaattgacaattgtcaaatgtcaattgtaattgtaattgtcaattgtaattgtaattgtcaactacatgtatatatgtatatatactcctgaaaataatctctctctttaattcttttcagaagcagcttaaagttacatggagaaaattcttaagtagttgatattacaatgtcaacttttgcctattttcagactttgtacttagatactatatgcaaattgcagttttgtatttttcccctgaggattgttctagtgttcccacctgccctatcttcacagctttttttatcccattcctactttatcctttgagacactggtctcattcattcactcatccattcattcatttatatggtaaatattaagcaagagtccctattttcacaaatctgacattgttgaccagggtttctcaaccttggcactactgacaatttggctagataactctttgctgtgggggactgtcctatgtaatgttggatgtttagtgacatccctgttctctacctaatatacgctgatagggcccaaataaatgtctcttgggtggcaaaatcaccctgtgtaaagaaccacagtttgagagagaagaaagacaataaagaaaaataacataacacaatattagtgatgataagtgctgtgaagtaaaatagaaaacgggactgtggtaagagtggcagcaggagcaagggttctaaagctttctcaaggacagcagtctgcatagcgcacagatgtagaagccttgtttctcttttaacagatgtctatcattcactctaaacctgtctatggaattgctaattaaggcaagagcctgatgtattacttacatgattaaattatttctggttcttgactatttacaaaatgtcacagtcacagtaagatttttttgaatatgtcaagtttctcaactgaatagaacattaataacttcaaatggactatcgcatgctattgattttactctcttgtttctgccactggagaacacgaacatcaataaatcacataggccctcagtgggtgattggagggtatatttatttaaaactcttccattaatttttgtttattacattattcaatctatcttatagctggtctgccatttttgtgggtttcagaattgtgaggactcttaatgggaaatgctgtgacactgtgataaatgaaagagcagtggacggtgagtagcacacttgggttctcgttcaggctctgttattgactggctcaaggaccctgggcaaagtacttcacctctgggcagcttctcttaaataaggactagtctaccttcttaatttatttcattgtttttaatgaagaaatgatatagcaaatgtaagataatcttttaaaatgttatattttttctttaaaaaattaggtaattataaggaagatttatatttctcagatattcttgaagttgaggagccacaattgtgactgtttccatcacttgatgtttcttctcctctaacctacttaaaaattgcaggcccctgtgctatcctggtaaatctccctccagtttgccagtatgtgtcatgtttcactgcaaacctcacacaattttctgtaagacatggcctaacccgaaaagtataaggaggctgttaaatctgtggttttggagcagggattttttttttcatgatcatcccccaccctcaaagagcctttatagacattgttttcgtagttgctcacctatgaaatgctaacatcacagatttatcccctgccctccgcagaatcaactttgctctctgggaatgatatggtggagaaagggaaagcgattgcctgagttgagaattcatgtttgactcaaagttaagttggagtctaaattcccagcagctttttggcagatccaacccagtccaaatctgctgtggctgtatagtgtgggacactggctcagctggccggatctggtgttaaatccctgctctctgcactggcttatccttcccaaatactccatgtttctgagtggttctttggctataaaatagcattgtatttcctgttcctgaggttgttgtgaggactaattgaagtaacatataggaaggttgttaacagtgcatggcagatgaaaaacagaaatgttcattattatttatacccaataacagcaatttttaaaaggaaaagggggagaggagaactaatgcttttaagtccacaactgcattctacatttgtgtagtggttattttcactttatttttaagctatgttcagaacgtaacttttgctcttgtttttctttgttaggtttgaccccatgtttaaacatacgtattagtctgttttgtgtttttataaaggaataccttaggctaggtaatttataaagaaaagaggcttctttggttcacagttctgcaggctgtacaagaagcttggctccagccagcctctgcttcttgtgaggacctctggaaactttcaatcatggcagaaaaggaaggggagccggctggcaagaaaggaagcaagagggggtggtgccaggttctttttaacctctagctctcctgttaactaatagagcaagaacttactcattagcatgggtaaagcacgaagccattcatgagggttctgcccactgacccaaacacctcccactagatcccactccaacattagggatcacatttcaccatgagatttttgaggggacaattatccaatctatatcagcctgacatctgcaaatttaattggcttttatgcttctcactcaaggtaaaaaacagaaacaataaacaaataaaatacaaccactactttgaggaggacaaggtcagggaaagccacaagcatgcaagtatgcaactaggaaatttccctgaggacactggttgtcaaccttgactgtataatttggactgaggtatggcctaagtgttggaattttaaataattcaccaaatgattctaatgggaaatagggtcaagaactaccaaatattcaataataaggaatccactcaaatagaccaactattactagagttttcttaagttctctgttgaaatccagatacacttgtctgcagaattcatctgttaggaagaaacttttcctctatgatcttaggttcaaatggttggggtcctgagagttaactgacgatagatagattagcagaataaaagacagtgtttatgtatatgtacattgcaaaccctcaggagtactcagtgatgagtaactcactgaatcctcaaaattaacattttatataccattttaacaaaatgtatttttttaaaagggcatcagtggaaacgtatggaaagtttattgggctttttgatgctaatgagaataggaagcctgtctccatggcagctgaattcacaggaaattccttgcaggggagttaatgggagctatattttcaggacattctgctttaatcagataagggatgttcagataagatttctttttcattttctgtagctcaaatgttttcacttgaaaataatctttatgctaaaccgtgatctctttacatgtgataactcttaaaatgagaaaatgacacacaactacaccaaaaaagcaaataatttaagcatggcattactgagtgctcattatgtcccagttttatttaccagggccaagtaatgtgtccaaagttaacagctaataaatagcaaagctgggagtatgcccaggtttacctgactccaaggtcaacactctgttataccacactgttcttaatatgccctagtggtaacagcctctctttagacttctactgaggttaataagctatcatacaattctgcttaagaagattatcagaatatacttttttctatttttggaaaaagcaaatgtatatctttttaatagtttttagcttcctagcagtgacagtgaaccaggcctggtgtgcctgttacgcagtatgccaatcactaaggtgacaagtttgcagcagagaaagagtttattcatgaggcagccaggtgaggaggtgagaggacaggtctcaaatctgcctcctgaagatgtggtttagggatatttgtgggataaagaatcagggtggactaaggtgtggggtaagatgattgaggtgtcaacaaaaagagtcagactctgtaaaatatttgcagagatttactctgagccaaatatgagtgactgtggcccatgacacagcccttaagaggtcctgagaacacgtcctcaaggtggtcggggtgcagcttggttttatacattttaaggaggcatgagacattaatcaaatacatttaagaaatgcattggtttggtccagaaaggcgggacaatttgaggcaagggcttccaggctatagataaattgaaacattttttagttgacaattggctgagtttgtctaaagacctgggatcaatagaaatgaatatctgggttaagataagtggttgtagagaccaaagttttaccatgcagatgaagcttttagctagcaggtttcaaagagaataggctgtaaaatgttttttatcatacttaaagtctgtgttgatgttaatgccggagaggtataatgaggcatgctagaccccccacttcccatcatggcctaaaaccgtctctcaggttaaattttaagagccctggctgaggacgaagtccattcacatggttgacagggggagattagaattttatttttggtttagagagattaaggaaaagtgaggtaactggcgatctatacgagcatagtcaagcttcgtggctctttacgggaatcatgtttacaaaatggtatttgttagcatgattttagggtggagtttttagtccctggacaacaaaaggtcacctattggacatttacaccagcccaactggagggttagtggtttcaaccagcttgcattggacaagagctgaccaagttcctgaaaaacaacttaaacaatcgttaccatggtgacctacacctcagcgatgttataagaaagttaggaaaagtttagtttatatcgcttagctatgtgacttttagctatataagttttaaaatcaactagaagcaagcagctaaaagcaagccagatgggttaagtttggtgggcctaatcaggtcagcccttgttttaagcagggtttaatccatcttatatgaaaaatttcttaacacgttgggatgcaattcacttctatatggaaacttatttagaccagctaatagctgtcttcctaatgcttctttatcttggcctttagaggcttccttccatagttttttccatagtcttttatctacaccttgttctccttaccacagagaaagtaatcaaaatggagttgtgtggtcttgtattctccttctggtctttaaaaataacatcaaccctcaatttcattcatgataacaagtgccctatgtagtatgtcctatcacttccatattttttcttactttaaaaataattaaaaatttcagatacttaaagcaagtgttaggtagccattatatttgcttaatatgagtattattaatttttaaaaaacgttaataggttttttgggaacaggtggtatttagttaaatgaacaagttctttagtggtgatttctgagattttggtgcatccattacctgagaagtgtacactgtagcaatatgtagtctttttttattttgagatggagtctcactctgttgcccaggctggagtgcagtggcatgatctcggctcactgaaagctccacctcccaggttcacaccattctcctgcttcagcctcctgagtagctgggactataggcgcccgccaccacgcccggctaattttttgtgtttttagtagagacggggtttcaacatgttggccaggatgttctcgatctcctgacctcatgatccgcccgcctcggcctcccaaagttctgggattacagacatgagccgtcgtgcccagccagcaatatgtagtcttttatcccttgccaaccgctatcctttcctctgagtctccaaagtccaatgtgtcattcttatgcctttggctcttcatagcttagctctcacatattagtgagaatatacgatgtttggttttccatttctgagttacttcacttaaaataatggtctccaattccacgattccatccaggttgctatgaatgccattatttcattctttattatggctgagtagtattccatggtgtgtgtgtgtgtgtgtgtgtgcgtgcgcgcatatatatatatatatatatatatatatatatatatcacaatttctttttctttttctttttttttttttttaagatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattcttcatggagtaatttagtttttttcaatttttgataaaaagctgaaggtatatcaacttgttattcagtgaaaggataactattggtagcgaaatataaacctgatctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcgttgagatggattgagaaatattttatatatattttttgagaaacgttttatgtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttcaatttttaaataactccattttaatattttgtgattgagctatttcaccatatgagaatcttaggtctttctgttttctgaaagttttgaaatatgacttaaagcttgaactaaatgtatggttatatcccacaattctcgtctcctaaccacccttccccaagattattcagaatgtcaagataacaaattatatttcgcggagtctcatcattccaacttcaccacgagtttttccttattgacccaaagtaactttactgctttctctgttgtctgaggcattaaattgccagccagctaggcaagtgaagaaattaatttatttagttgaataataattctaggagaattgagtactgttttttctgtctcctttctatcatttgtctaactaatctctctagcatttggtggtataaatacagaatagtcatctattttaatcatctaaccaggtagtgtatatcatcctcacaaatagtgcaacttagattccagtcttattgttaacatcctgctaccttcaaatattttatttatttattgagacagagtcttactttttgcccaggctggagtgcagtggcatgatctcggctcactgcaacctctgcctcctgggttcaattgattcttctgcctcagcctcctgagtagctgggataacaggcatgttccaccatgcctggctaatttttgtatttttagtagaggcagggtttcaccatgttggccaggctggtcttgaactcctgacctcaactaatcagctcacctcagcctcccaaagtgctgggattacaggagttagccactgcgcctggcctaccttcaaatttttgtctcagtggataagacagattttgttacccattttcttcttcaaattgacttgtttgttctattaagatatacattttcacttccactttctaatattgaatccctcagtttccctttgtaaatacatatgtgcatatgtgtatgcacacacacacacatatatactcccaaacacacccatatattctttattgtaataccccgcttgttgatatatagttatgggaggacaaaggtattttctgtaatatggttgtgttctcctatgaatgctttgggaaattccctaatgtttttctatctgtgtcatatctattatatttttataacccttgttaacattttaatattatttttattttcccataaattttatgtttaaatcttctgaattagatcagcagttcaccagagaaataagtcttccgtgtccctttgaaaatactttctaagtcacaaatccccaccaagtttggtatcttaaatcatgattctgccaccatctatataaccagctgctcagcatttttcctttcctaaatcacacattgaatgggaggaagaattttaacacttggaaccctttaaaggaaccctttagctttctgcctaggatgtcatgaattctaaaaatggtttgcatgtgtattatgatggcatcattcatacccacatgaatcagcaggcatggatagttgtcagcaggtgtgataaggcttggcagtttttccattatgtcctggatacatgctgcagaaaggcaatggcttttctgtttggccatgtcaagtctacataaaatttactcattctccttggtgaatgactagctttgttcaattagatagccttcattcttttctgaaaataaactgttatttcatcctaagtaattaatatctgaatttttgtatgttttggaatttctatgttttatatctgtaataaaattaagatatatgtacatcttaatttattgagtcaatattaatatatttctgaaataattcaaagattaatagcactattttataacaacattatagacaatattggtagatgcatcattcattgttatttggatgacttaaattatatcagaattactaaataagaattaaatattgataaaaatagagggaaagagtatcccatactgtgccatctttgaggtcacagctcatgaaagagagaaaactgcaaaacagactttatctttgggtattatttcacaacaatcttatcttactttgttctgtggttggcaggccgtgtgctatagaggccaacagccagagtctctgcaggaggatttcaaatagtgccaaatcagaaagagatagcagccaaagggaactgacattgcaattgctagaatttctcctgaaaatgttcatattttaggtaaaaataagcaaaattatgttactgcagtcactaccatgtaaaacaaggggcaatcttggttgggttaagttataacatgatgttaaaaatggaaagtacatatctgaaagatattcatgcagtcaaattaataaaaatgtcagaataagctatttcttattctggaggttgttagaaatgaagtagactaagatgcattctctgttagggaaagtcatgaaatacagtcataatttggttctataattcctttcatcaatttagcacaaaacagataattaaataaaaattatttagtagtgataaaatttgtattctgggagttaatcatccttgttaaattaaaggacaaattaatgttgggaaattctgggacagctaaaagacattaaaaaggacattaagtatattaattaaaccatatcaaattgccattttttggtaaaaaatggttgatatttataattacatatggttcaatttaggtagtatttaattcattatttacattataaatatttatataaatttatctttttccaccagactctgagtcctgctagtgcaggcttattgatttatgtatcaccagtatatatcacagtatctgatactctacagctgttgaaaaaatgttgaataagaaactgagactattcgccaggacaattgtctccagcagtttgattgactatcactcaaaatatatgtacatgtattgacttacaaattatgttctgattcattatacatgttacatcataaaacatatatatacatatattaaacatttttaaagataattttattttgtctaggaagaagacattggcttagaaaaactccaacattttagcctgacagtaaatactaaatttgcaattgcttggaaagaacaagtgcagtaatttaaatctggcttttcatctttcttattttaaaggaattgaattagggcaaagaaaaggaactaacttttattaagcacctggaataagaaaacaaatttatgtacattattaaatttacacttaacaaaggaagtattattttatttatatattgatttattttttgagacagagtctgcctctgtcacccaggttgaagtgcagtggtgcgatctcggctcactgcaacctctgccttctgggttcaagcgattctccggcctcagcctcccgagtaactgggattacaagtgcccaccactatgcctagataatttttgtatttttaatagacacaagatttcaccatgttggccaggctggtcttgaactcctgaccttgagtgatccatctgtctcggccccccagattgatggaattacaggcatgaaccaccacgcctggccagaagtattatttttgctaagcagaatttaaagctgaaaatctgagaagttagataaattgtccacagccattatccagttcctagttccagagcctggcctaaaacctggtctgaggtctggtaataaagcctgacatgtgcgtttccttcctaaaaatgatgatagtagtctatcaatgagggttaaaaaatggacatttttcataaatttatgcattttacttctgtatgacctgtatggagaaaagtgattttctctttttggtaaataagcaagactcctaaatcaaggcaactattcaatatttctaacttcttggtttcttttaatagcaacagcagtagcaacacaagctaactattgcttactgaaaacttgtgtgtgccagtttctttttttttttttttttttttttgtgtgagacagggtcttactctgatgcccaggctggagttcagtggctcaatctcggctcacctcaacctccgcctcccaggttcaactgattctcctgcctcagcctcccaagtagctgggattacagatgttcgccaccatgcctggctaatttttacttttttttggtagggacagggtttcaccatgttggccaggctggtcttgaattcctgaccttgagtgatccttctgcctaggcctcccaaggtgctaggattataggcatgagccactgcacccagcagtgtgtgccagtttctatgataaatatcgtacctaaagttgcctcatgtagccttcataattacccggttgaggtattatttttaccattttgctcttgtgaatactgaggcttaaagggaccaagttggccagtgttacacagaaggtaagtgacagggctaggatttgaacataagtttcttagactccaaagtcccttctctgtaatcacaataaatactgctgcccttctgaagagccagattttgtgatgtgtccatgatgcttcctttattttacccttctcaccgaggcccagataaatgtgtttgaaaaccattcaatcatactcattgggaatagtaaggtaaataaaagcatcaaaccttgtagaggaatcctttgtcctctcagtggcatagctagtatttcttccatggctagctgattaatggcagacaaagcagcatgcctattgcacatatctatagcacaagctatagtaacaagacttatcaatatctcaatgctatagcaagaaaaagcattcagggagaattatgcaattatttttctgtagtttctgactccttgatttgggaaagttagtagctgaatgctcagagagagagagaaagagaagggttgtaactatatagagggttaggttaagccttgtggattagctgcagttggacaggagcttggtagaggaataatagactttccatgttctttcattcaggcccactggctatttcattcaccgctttttaacttacatttcatgacttttctagaattaacagggcaaatggttcaaaatactgccagttaatttgtagataattttaaattctctcatcattgtgagatattgtggtacagtgaaaaaagtactatattttgaagcaaaacattgagaccctcttttaccatgtactaactgtaaatttgtaaggtcacctctattttctaaatttcttttttcttatttatgtatctatttcttctaaattttttgtagagatgggggtcccactatgttatccaggctggtctcaaacttgcgggctcaagtgattctctcaccttggcttccaaaagtgctgggatttcaggcatgagccaccacacctagctattttctaaatttcttttttttttatttttactttttattatggggaattttaaatatgtacaaaagtagacacaatagtaataacaaaccctcatgtattctacctagtttcaaaaattatgaactcactatggcatcttatttctttgtccttctcactttacttttccattttatatcatagtaaatccgagacatcacatcattttattgatacatattatgttttgtattactaaaaatatgggctttaaaaaccatatataaccaaaataccagaatactacctaaaataaactaataactttttaacatcatcaaatatacaatgatctaatttccaattgccttacaaacttcattttttcccccctaccattgggtttttggaatagggattcaaataaagtccatccattacaataggttgacattattttaccatctggattttgctgattgcaaccccatgataatcttcaacatgttcatctgtcctctatattttctgtaaattggtggttggttctagaggcttaatcacacttaacgttggatatgtttgtttgttctcgtgcaaaattacttcatagatgatactgtcttcttccctcagaaggttgttaatgtttgtgtctcttgtgatgttaggaaccagtgatgatcactatctagctttattaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatttcattttaaattataaaacccattaagagtttattttgataattccaactcaaatttagaactacaataatttaatcttctattttatgtctgtatctcctttccctgacagtgaaaaatctaggtttttagtgataacagaagtggtagaattagaatattatgtagtcatttgcgttattccaaaaacaaacataagagtctcagaataccaatactaacatgaacatatgttgtaactgtaataaatatgagcaataatattgcatatgtaagagtacacagtaaattcaaagctttgtacaaagttaagtagttttaaaatatcatcctgaaaatactgtagatgtatttccacaaatctccgaaagagaaaatattgttagacgtatgatacaaactgacaaaagaacttatattagaaggtaaactttgaattattggtctgcaatatggtaaaactgaatattttaaatcaagacaaaataagacgggctgggcgcggtggctcacgcttgtaatcccagcactttgggaggccgaggcgggaggatcacgaggtcaggaaatcgagaccacggtgaaacccagtctctactaaaaatacaaaaaattagcctggcgtggtggcgggcgcctgtagtcccagctacttggagaggctgaggcaggagaatggcgtgaacctgggaggcggagcttgcagtaagccgagatcttgccactgcactccagcctgggcggcagagcgagactccgtctcaaaaaaaaaaaaaaaaaaaagaaaataacacgatcaccatgtccaacttccaaaacacttttgctgcaatattcctatgaatataataagatttcctaagaagcaagggcattttaaaggaagaaatcattttgttctttcttaagatctagaatttaaactcacaatataatctgatgcattgtaagttatggagagtatgaagtctttgtggggaaaatgaactagatacgtaattatgaatacaatccatgaaaggtaactaactgtttccagatatacttaagaacactcattttatttctatgtctttacttttaaaggactctttgaacatcaataattactaaccagttaggttttatattaatattaatatgacaaaaaaagaaaaaaaaggaacagaatattagtgaaaatgtgggtcttctatttttgctgcatgataattgatagttttccaacatattaataaggcattgctggggttttctactgtgtatagtaatataaaatatttgtagcatagaatatattaaaataatagtacaaataaaatcaattgaaatacagtcttatgttactggatacaataatttgttaattaaaattatattaatttttaagactgttccacatattacatttaaaacttttaattaatgtttttgaattaattgaagctatccaatattgtaatttacatagatttagctatgggatgaagtataaagataaattactttttttaataaaaatggaagaaaatatccaattaatagttgctggagaagaaatatcacaatatttcttagataacttcttctcctataagtatatagtattgattacataaaatttatgttggtaaagtgattgatttatcttcttttattatgtattttcagaattcaagacttagttgtaaaagtattcatatgatgtaattagcttttacaaatgttaaacacaatcttattccaaaaggtatcttaatttgtatcaaagtaaatctcttttgaaaggcaatatgtgcctgagatatgtttgtgcataattagattgttctatctcaaagttgcttaaggaaacaaagctattatgttgtaggagacagtaaaatgatttaggatatgggttctggattctagttcagattttctgtcttacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatgtgatgagtgctatgtgaaggaggacagggtactaggttagcacatagctgaggctccttactcaaatcctggatgatcagggaggtgcagcctatgctaactaggaactggattatgggaacgagggatgagtgatccagatagcagaaacgatatgtgcaatggctcagaggtaagaaaacctggctcctgtgaggaaatgaaatgttactcggtatggatggatcatgggaatcagaggagtaagggatagcggaatgtaaacaaagacagatgaaaagaggctggactatgaagggcctcataatccacatgggagaatatgaacttgatcctttcagcgatgtaggcactcttgaagccttttaaaattaactctgcttgaattgtggccaatggccgacaccaacaggttgatcctgaaagcaaggaacaagaagaaaagacatgaaaacaagtcacttaaactcactgtcccttatgacaggattagcataaatcatttcttttcttttttctttttggtttttttttttttttttttttttgagacggagtcttgctctgtcatccagtctggagtgcagtggcacgatctcgactcactgcaagctccgcttcccgggttcacgccattctcctgcatcagcctcccgagtggctgggactacaggcgcccgccaccacgcccagctgattttttgtatttttagtagagatggggtttcaccatgttaagccaggatggtcttgatctcctgaccttgtgatccgcctgcctcggcctcccaaagtgctgggattataggcatgagccaccgtgcccggccgcataaatcatttctaaattcactcctagccatattatatgagttcaaaatcttttctacctagtctagactctagagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgataagtttttgacatttggaacagagcagtatcagatgcagcactatagtaacattaatacaatatgacaaagtggtaactaaatattgtgaaatatattattctcttacagatgtgtctagtttattgacagaactgatttatatagtgcatttcatcctaggaaagcaattttatgaaacattattataatggaaattgtgttttttcaattagttgttgaacgccaagactttaactcctgggggaaaatgtttataaggaatactttctgttaagagtgggcatgtgggcacttcattagaaaggttttatactagaggacttttataggtggtataaaactccctcccccccaggttttgtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctctgaaaataatttctttaaatgaccatttgaaattaaaaataagatttatttttggtgttgaattaactgcaaatacaagagtactacaacttcttagacaagtaggctttaatgtactagtttaaaatacagagttgtcttgtctgccagtcaatatttatgaatttattcaattttcatgaagtttgataaaaaatttggcattttttgctattgcacttactaagaattaatcctcacacttcctaaatcaaatggatattcttaaaagcaaagacatcttattagatatgcatttaattttgaaaagcgaccttctgaaacttgtaagtaattactttgtaaaaactctagtggttgagattcacgttccagaaaaatcttgctttaaatagctttaaatgggacatatatggttagcatggaatgagaaaagaaaatatatgccctctcattgatattatattattggattattatgctttgtggcctttgaactggtgaatattagagccacttgttacattatctatcaaaagaaaaatatttttaaacatgaggattggggtttaggcaaccattttacaaataaatcaattaatatttatacagtacctaatgtatttaaatttttaagttcagtttaaatttaaaagttcagttcttcatggaaaacaatatagtaaggaagaaaaatcatgaatatgttaaattattaaaatgtaaacaaaattggacaattatacatagtgataataataactatgttttcctggatgtttagtctagtgaagcactctacatgcattatttcatttaaaagtttacagtgggaatacatttaacttcttttctcaacatgcagatgagataaatacaattatcattctatttcatagattggtatactgaggttcaaaggggatgagcgattcgcctaaggacatagagtccagcttcaaacaataaagtctggcttcctacatgagtaatttcacaaactgagttactaaggcctctctttcataaatccaggcatggagatcctgtgttaatggaattgagatccttccaggtacagtttgaaaagtctaccctagtggtctgcaaatggaaaataacattttcttcatttcttttaaaaaagcaatttctctaatgttttgtcttttacttacttcagtctgtccattttagtagtttttttctgcttagaattgatatctgaattataaatgctagctttatttttggcattaagaaataatcacaactgggtgcaatggcacaagcctacaataccagcactttgggaggctgaggcaggaagattgcttgagtccaggaattttgagaccagcatggacaacatggtgaaatcccaactttacaaaaaatactagcctggtgtgatggtgagcacctctagtcccagctacttgggaggctgaggtgggagggttgcttgagcctgggagagggaggttgcattgagccaagattgtaccactgcactctagcctgggcaacagaatgaggccctgccttaaaataaattaaaaattaaataaataaatgaatgaaggtaggttgagtataaagtatagtgtataaatgatgagttaaagcattttaatatttttttcagtgtatttcagtacttatcttgctataactaagccagaatgcatgatgtggggattattatccatttgatatattatcctccttaaaatatagtttatgtaattcaaagcatatgtggattattaagtgcacattgtttatagttaaataacttgctggtgttcatccattgctccctgttggaagatactccaatgttgaaagcaaaatctctgctgtttgtttaattgtgccccagggtacagttgggaatgtgtctatgagtgaaagaacaccagttttaataagaatacaatgtaatttaacagttcataaaacagtaaaatttaatcctgaactgagagatttattaaatttcactcagcagaatagagcatgggatataagagcaagtgagaattaagtgaaatgatttcaggggtaatagattttattacgtgataaactgggggaatcattctttttttgaaaagctatttattcttaattcattctttggaaataattgtcttacataggaaagctttttggagacaaaataaataaacttgaaactattaaaagcttttgtttaactttatttgtttaatttcaaaagagtaaaactatactactaaaatcatatcaccattatggctaaaatattttaaactgtaagtgaaagtattttgcattcagggaaaaaggaccagtcttctttttgtaatattcatttaaagtcctcccaaactaaatgatgcttgacaacatgctgtctcagagagtttcatttttgcatatcaagtagcatattaaaaaattcttaggcatattctctgcatctgtaatgattgattccattggagctttacctaaaatgggaaatattttaaaatttattttgtttttccctttcttttaaattatgtaaagaagtattaaacagtttgaacatgctattgaagattataatgagttacattagtaaaattttctcaactgtaagacctacaattgctattttttattttcctttttttgtaggggttgtaaaacaattttctgagtaaaagaaggaggctcccccaaagctagatgtctctttatttgcataacaaaacagcagcaactattgagtgtatagagatttagctgtgttttaatacacattgtatctattgagcttcattacacctagtggagaaagtagggcagatattattgcacctactttataccttggacaaatgaggtttggagaggttactgtttaccaggggacatatggctgttaagtgcagaacagattcagcaatggtcatttgagttcaagtcataaagacaccattaaggccctttgttgtgtattaaccagccaacatttaatattagtttttaatgatataaataattttattacagtcacaattgtgtttgtaattattcaaaatccatgaataatttcaataattgactgttttaaaataagattttaaaaaataaaaaaaggtttctttaataatcactagctagataaatgcagcattttattttttttatttttttatttatttttatttttatttttttttgagacggagtctcgctctgtcgcccaggccggactgcggactgcagtggcgcaatctcggctcacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagcattttattttttaaacaaaaatatgtatatgtaaaatgtttaacattgttgagtgatgaaatacctgtgaaagtttttataaactacctaaatatgaattcagtgatatttaattaaatgactgtgagattatggaattaaatatatatatttaattatatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttgatggacatgacatgaagtctcagtgattcttcagaaatgaatctgaacagaactatccaaagacagttaaatggttcaaagaactctaatattgagtgtcctcttttgactccatctagaaagatcatagcattcagggagaagaggactgctggatcacacattagtcttttcaagcatacctgtacacagaaatagtctctagggccactatctttgaattccatggctacaaatggaaacaatgtgaattgctgggtggcctttgtggtatgtctggtgctgagcaataataaaggaaaatgaagggaaagcaagaacacttaagtctgtgtgactctaatgatttttagtcatttcttctttttttttccccatgcagctattttaagttaatacaggttcccctaaaggcaaatataactgactcattaggaaatcagttgggaaaacaatattttgcaattgtggccccaccccttcatttctccagagctcatgatagcacacatgctctatctctgttggctatatttttagctttcccacattattttgcaatattcctttccagactaaaaaattaacaaaactccacactgaagcaacaaatcactatcttacacaataattcactaaaataggaccttaaggtattttgcctttcttcaaactcagactgaaagcttttctggtcacgatttttcaaggttatacttttataacaaaaccagatgcaaagattttacctaatcagattttacaataatgcccccatttccctccctccctccctccctcccttcctttcttccttccttccttcttttcttttcttcctttgtttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcctttccttccttcctcccttcctttccttcctccctcccttcctcttcctctgtctctgtctctgtctctctctctctctcttctttctcagacagggtgtcactctgttgcccaggctagagtagagtggcactatcataactcattgcagcctcaaactcctgtgctcgaatgatcctcccatctcagcctcccaagtagctgggactacaggtgggcatcatgaagcctggctaatttttttattttattattttttttaaagacagggtcttgctatgctgcccaagttggtttcaaacaatcctgcctgagcctcccaaaatgctgggttttgctttcctgacaccggtatctcctggttcaaataatcctgcctgagcctccccaagtgcagggattacacgtgtgagccaccatccagccccaatttctttctttcttttttaaaattaggttcttcctaattacttctgaatgacagtgaatgacttaggctcttaatttgcctttgaatccaggtattcagggtgacaagaccaacatttgcctggtctagtttgataaatgactctgtctaaaatggtgtcattaagtacgtgccttgacaggatttgaagtttttttctaattcaagatgctaattacagctttcttgtccagttaatattcagctaaaaagtacacatgtcaggcaggtcagtttcagatacccatgaggttaatctagaagcaaactaaagtgaccatcaaagtataatattttcagtacattttggatttttaaaaatgtatttgttttgctgagacacttctttgtgactgaatcatcagacttaagagctggcttttgattgtagatctcctagagtcagcccagacagactcaacagcaggtatagattccagggctgtctacaagaggccacagtgccaggacaaatcatgctgggcgttccttggagacgctcatgtacaaatgaaataatgtttcaaagaacatcaaggccatcctccagaggaacaagaaatgacaaaaggacaatgtacagattgagggtcttggcagaaaatcaaagtggctgtccctactgctttgatttgatgacaatgtggtaagaacattcgagtagcaggatttgtttttaacaactgagtgatttcctgggtgccaaagctctgggtcagtgtaatgtcctaatttattcaatcctgaaaaccactctgaatgtgaggtttctagaaatggcatataagtcttatttagtcactctttgttagttgctgatatctgattaaacaacacaaattaactagctgtttgaatgtgttatgaatgtctatgtctcccagaagacacacatttcttgtctgatttttcttactatgtggaagttagcatcttattcaatttattagccaatcaaaatcatctgtattttctactaaaatcaatccccttttgaattcatctcatgccattaaataagtaaccaggggaaattcttcttctttgttcactcaaggtttaagaaatttggccagatgaaatagtataaatcttttatgaaaaataacatattcctgttaattcatctaaacttagttgaaatttaaaatatgttagatatttttctggactagtttcataggtgtgtgatctatatagtcacatgggaccttatttaattcttaatattatttggaaaagaggccatgcgtttttttgtttttttgtttttttttcctgggccctgcaaattatgaagccagccttgtttgcttccagtatttaaatagtaccggtgtttgcacaaataagtctaagaacaaaaaccacttgaatgtattatctgatttgacaagaaaagagataaacgtttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccagacgcctccacttgcaagtttggaaactcaatatcatcttccgtgacatcttcctgaaacctcttgattactgatggggatacagcagtcaaatgaagtctctatacacatagagattatgttttagaagagggaaaagataaccagcactctgtgtgtgtgtatgtgtgagagagagagagatgagaaagtgaaaagtgctctgaagaaaagcaaggtgagagaatgaagaaatatgtgaaagtgtatttctaatagcatttatctgcattactttttatctcagtgaatattatgaccatcttccctttggcccaaacactaataaacctgggagttattgtagcctcccttctcttcattatcatcattgttattattttaaagttgaggtctcaccctgttacccaggctgaagtcactaggattatttttaatgagtttcctgaaggatctcctgcctctagtattataccaatgtgtctgtcattctccccactcaggaagtgctctttcctaaaagtaaatctgatcatttctgtcctctgaaaacactttaatatcttccactcatcctacagataaaatctacgctcctagccatggctgacgaaatcttcatttttctgtgtgtgtgtgtgttttgttgttaattattacttattaccttctccagcctcatccattatcactgcaaatccacaccttcactggtgcttcatctatgaggaacatttttcagcttctcaacactgtcttgttgtctctcatttctgagctgtcacatctttctccttctccacctaactcttagacttctttagtgtcaacatcactttcttctgaaagccttctctgagtcccccaagttaatttcagttagtgttttttgtatgtgcatgctatagcaccctgttcctcatttcagttttagcatttattcaccttaatttgtactgcatcttcaattgcctacattttactgggcgtgaactccataaaggcagaccctacatatatcttgcttatgtttatctctctagcattagcttagtgcctagcatagggcagctgagtactgaatgcgtgtgtgcttttttaatgtgtgtttcactctgaattccttctgaatctaaatgacattatgtatatgttaatgtagtaatatataaataacaatgataatggctattggacacatcatttttttttctaggaagaatagtggaatgattcaattatttcagattgcatttcagctttggagactgcatttattttgcaaaagctacttgtgttagtcccaaaattaatctgcctagcctggaggcaggtacctgctatgctgtctggagaagtcacatgaaaatagtcaagatatttttttccttcaaggagtgttttcttatgaaaccaatgcctctctctccctctccacgaagcggaaattaattttataactggtattcttgaaagtctgtataaatggaaggcactattttaaagtagggtttcatctgagtgcatgtgattaaaactactcttcatctagaaattagaaacatggcagatagcaaatttggattttcttatacatctacttaaacttaatttctccaaaaaagctatgagtcatttatttttgtggaatcctttttttattgtatcacaaagcctaaatttaaaaaatgttgcatatgagtttaatatcattaacatttaaactgttcttgattaaagtatgttaaaatgtctttgttttgcaagatgcattaattagaataaggatccaaacatcaagctaaagcattctctaatttgaagagattattttaagaaaatgatgaacaaagtccagcatcattggaacatatttgcctgatatattttatgcacttattccacttatgtttataataactattcggtatgtttgggcttttgttcaggttgcttttagagcaacctgaaaaaaaaaattgtaatatttactagaattttgtttaaagtgaagtagctatattattaagtgtatgtttctaatcatgacctcaatttttaaagaatcttgtgtttaaagatttaataattgaggatataaaaatgatatcctgaagagttcctgaaatatttgaagcattaaagtaatgtttgatataaatgagcacctgttgaagttctatagtattcaattggaagaataatatcttctacacttacctcaaattcttttttatgataaagttggatataaaacctaaaacaactattctagtttacaacatctagtcatgacagataattgtcaaactgtgttttagtttactacagcatgtctttatggccaaatgacttctgggagtgttgtcctctgaagttgagcttcctactcacaactctgctcaagacagaaagaaagcatattagtcctgttccaaatgagccccattcttagcaagtgctgctgtaatttaatttaggtttgggccttcacttgcaggaaatagacatgatgttaattaacagaacaatgcttgtggaaaagctttatgatactacttgattaaccacattccttttgatgttcatttttggaaaataattgtttatgtctcctgacacagtagataagatggcatgcatggctggtgtttgtaggtgtccaaagggattgtctttagactgatgtggcttttaggcaattctttttatgtaacctagcaatcttggtgcctaactcctacttctggttgactttacatatgaaaagaggggaaatttgtaaacttctgagaaattagaagtaactcaggtaaacattgaatactatctagaattcagaagaaataactgctacttttaattgaaattttaatttgcttttggtccattaattctgcggtttatcagcacaatacttttataattcttacatatcaatcatgagtaaaattgtgctttagttatttaattttcttccaaacagtaatcaattcacctttttttctccttaagagagtattcttctcacagaatgtagaaatataaaaaagaaaggtaaacttttctgtaatcccattaccattataaacattttggatttattatgatctctctttctttctttatgtatttatggagatagatggataagatatacttaatatgacagtcataagctatattttgttttacacctaaataatgtacattttaagaatatgcatagttgaaatacatttatttgttaaaataatgaggtatatctattaattctaacttggaaaaatatattcttagatttttttaaagcaaattattgtatatttgacttttgattaaaataataaaaataaacacaatatgtgtgtgactgggtctatgtaggcccacactgttgagaataattacctctgaggaagtcaggagcatgggtggtgggatctgaaatgttttactagatataattctgtactattacaatgcattataataggaatatattattttatgagtatggaaatgttaacatccatccttatgtcataaatataggtctagataattattttatttttatttttatttttttttgaaacagggtctgcctctgtcacccaggccggagtgcagtggtgcaatctcagctcactgttaacttgtaccacacaggctcaagtgatcctcacacctcagccttccaagtagctgggaccacaggcatgcgctaccatgcctggctaatttttgtatttttagtagaaatggggttttaccatgttgctctggctagtctcaaactcctgggctcaagtgatctacccatcttggcctcccaaagtgctgggattacaggcatgagccactacactcaccctgtataattttaatagtgttatttatttatagaaacacaacataaattgcttaaccttgttgagaaacattaaggctgctgcattttcaagtaatataagccatgttgtcatgcacacatctgtaaatgcatccatgtacatttttccttttttgttccatggaataagtttctcaagtcaaactacaatgtcccaactggtgtttgacatgcattttcagactgttctccccagtgatattaccacctttttctagcacctaatcatagctgctagcacatcattattcatctgtgtctggtgagcaaattatggtttctctcacctagaaatgttatggattctctctcacctctagatgaggaaagtaaatttttatcatcaagagaggacatagaatgaaagctgtcttccataatctttgtttcataatgcacattgtattatgttaatatgagggacactgaactctaaaatagatgcctaaatcatattgtttaggcacacagctatatatcacagtaatttctattatctaaacctcatggtttagatagaaaaaacccacaatctttggaatttaatagcctgggtttagattttaggtgtgcccattactcagtgctttgagccttggctccttggcatgtattgtttatatcatgagattgttaaagaaaattaagttaaataatatcttaaagtgcctactgcagtgccatgtggtaggtattatagaaagtaaccttgtggctaaataacttctttgtgaaatatttactatttttctgatttaaaaaaagacagattatcatttaggatatatagttaaaaactgacctaagaggctaaaattatagctgatatgcttattattgctctgatttttttatatctgtactaaacttcatgcttttaacttttggttaagggtattccttctggtttggttaatttcaaaagtataagaaaataaaagtaaactttaatcttctaccttgcatgatggatatgtgtaatatctttgtactgttttccttggaaaaaaaagtagatacaaatgcccaagtatacagtatgttgaattttgctcaccatttgacataaatgaaagtatctttgtagtaatttttctttcaaaatgcaatagaatgtgtatattcattgggtagcctttaagaggtcagaaagaaaagacactaaaggatatacaattgcagaagagggaagtggaggagtttagagtcaggaatgcagaggaagagaagaaatattatctgatgctgtgaaccctggaaatacagaagtctactcaatagttaagagccctttgctgagcttcattggacatactcaggtgctatgatagctatttgagtaaatgtatgctttataggagtctcttctcctggattctcaaatctagcccacaagataaactcaaggttaagattaaacaaattatgagtatctttttgagtttctttctaaataaatgtatatacttgtttgttccaaataacgaggaaagaatattttatgctatagcctgtcaacctaagtaacagtgagagaggccctctaaaagaaaaggtatttatttgaaaataaagcattgtaatgggaatatgcacgtcaaagtaaactatgcacatagttagggaggtaaaggaagacagaggttttcaaagagaaaaagcaggaagattatataattcttctgaaataattacctttggctacagagaccaataacaaggttatcgccagtccgaggttagacaggcagttgctgggcaaatgcccttgtagaaatatgtttttgtgtaaggttctgatggcctttgtgcaagattgtggattttgtatttttttgttatcagacatacaagaatggtaaccttctctttacagtgttctctggttctgccagggctttttgtttgttcattttttaacattagtgactcatttgattttgacacctttcacaagtctatcgttactgccttgttttttctgaaatgtcttttttgttttttctagtgatgattcttatgcttttaaaaacatttctaacatcctcctgttgcttatttatctgtggagttgctgttcattctggttttcctctgagtccttgcccatacgtcaccaccctgtcttaccttggctgcagctgttgctagtcatcagatgaagcaggtgaaggttatcaaactgttatttttcctgagtaaagtgtcatcacctcacctactgctctttgtcttctttgaattaatttcctaaatggcatacgattcagtgcaaaaaaattgttgttgtaatgaaagtcttttatgtcctggttggtgatttataattggtttcatcaagtataaaactcagaagtataaatgtcaagagttaactgatacagcttaattggtcatttccaattttgatgtcagtctattgacctaccggctaaaagggcattgtagagtattagttggcatttgtttttggagtcctttatgatttctttcttattagtgttcacagcagtgtaccattaaagtttttggcttcagtacacattctgattattcctgaacctgcatagtcacaataggaagggtagtgttgattcaaacaaaattcagatccatgtatttttggcaggtatagtgtgttcttctgcaccaactcacatattccattttgtgcctttacaaaactataggaatagtttagtgattgcctaaaattttcctagtaaattgaatgtttttctacaaaaatgtcttaaaaatcagaagataatatattcagtaaatttattttatgtacctattatattgtctagtactttaatatgtataattatttatggtttgattttatacacatctcattttccttaaatgtatattccaacttatatggagataaaagtaatgatatcactttgccttgaagaaactaaactctaagactgttatcatttgattctttcattttgagctgtctaaaattttataaaattagttaagagcaaaaagaagcatattagttatctttcttttttttcttttttcattaaaaatttttattcagtgcaacgggttgtataacttttatagacaaaaagtacaaatagctagtgtggtttgatttaaatttctatttgaattaaacatttgaatactttttcacttgcaatttatccttttagacaaatttctggaaccttcatttaaatgaacacagatgtaagaaataaagcggttatggaagcccagttctggactcattattaacccatttatgcctgaggttgcaattttttgaatttttattttgttttattttatttttatttattattattttttattattattatactttaagttttagggtacatgtgcacaatatgcaggtttgttacatatgtatacatgtgccatgttggtgtgctgcatccattaacttgtcatttacattaggtatatctcctaatgctatccctcccccctccccccaccccacaacagtccctgttgtgtgatgttccccttcctgtgtccatgtgttctcattgttcaattcccacctatgattgagaacatgcggtgtttggtttttttgtccttgcgatagtttgctgagaatgatggtttccagcttcatccatgtccctacaaaggacatgaactcatcattttttatggctgcatagtattccatgatgtatatgtgccacattttcttaatcccgtctatcattgttggacatttgggttggttccaagtctttgctattgtgaatagtgtcgcaataaacatacgtgtgcatgtgtgtttatagttatctttcttttaaagtacaggataatttgtcttcaaacatagctggatccaggtgcccaaagaaagtccttatcaacaggttcctcttctcccacttcctctcttttctctactggcttcattctcagagggagatataaaggtggcatcaaggtttataatccaccagtctgggaccccacaagaaagaaagtacctctttcctaatggcttcctcaaaaagcttgggtttaactaatgagctgagcttgtttcacttggccatgcctgaagcaatagctgtgacaaggcctgaaatatatgtttatacctggagctaggagattaaagcaggaaatggactgaagtggaagaggattctgctgcagtaagaagagatgttgagaaggcagaacaacagttcccactgaagatgccactgagttactaggaccatactcctggtcttctgagttccatattctactctttgagtctttcacatggatcagttctaagatgaagtaagaataaacttaaataaatcctttaatgtttatcctctaaaaggacaagaatattttaatagcctgaaagcagatgttgggaatctcagaaaatgaataaagtataatcttgaaaaaaactagtgaaacttctggtttgatctcttccctaatgccaccattcctctcaacttttgattctttagcttttttccactccttttattttttgaagctattgatgttgctagaaaaatctttgaagcaaagactactctctaacattaatagataggaactactccagatgaaattaagtacccttctattaccctgcatatggcattgcattaaaattttggtttacttgtttgtcccactcacatactgtaagtactccaaagaactaaatcatctttgatttccaagttttattgcccaaccacataattgtatttgttgtcagtaacacattaataacataagtgttgttgaatgaccaaatcaaactgtaatgcacttacagacacaggaaacaacacaatgagaaagtgtatgttcatatggggcagggatattcaagagaactaagaatgagcaagcagaggcatttcctcatggcaataaaacaataattagttaaagcaatatattttcaaaataggaaacatttatgttaattaaaatagtgaagagggccaggtgctgtggctcatgcctgtaatcccagcactttgggaggccgaggcgggcggatcacgaggtgaggagatcgagaccatcctggctaacatggtgaaaccccatctctactaaaaacacaaaaaattagccaggcaaggtggcacgcgcctatagtctcagctactcgggaggctcaggcaggagaatcgcttgaacccgggaggaggaggttgcagtgagccgagatcgtgccattgcactccagcctggcaacagagcaagactttgtctcaaaaaaaaaaaaaaaggaaaaaaaaaactagtgaagagatggaaggtcttcaagttaaggatctgaggtacactataaatatgagtgtagaaatcaattcttatttaaaaaacaaaaccaaaaactctgtcccatctaaattgatattatcagttgttaacatacttgagattttcagttaagttgttttataattatgacatatttaaaaagctttataattcatacttttataaatttatctaactttattcttacaacaactctgtgaggtagcttaccatattacttaaaggtgaggaaaatgaagctaagaaagataacatgacttcccattgccactaagaaattaaaaagctaaaactctaaatctcatattctttctatgaaaattgtactttttcaaaattttatgacaagttgctactacaattattgtagagtaatgagcacaagatagaaagctaaacacaataagaacataaaaagtcataaaagatgcatattgatatgttttgtttgcatatgtattgtttcatttttttcagaatatctctctaactttttaagtctttttcaaatcatgcttacagatggcctttgctataatttaatttttaggttatcagtttttattggcatttggaattaatacttacgtgaatatttgaactcatggacctaaatttctagtgtatttttggtttgcatacacctaggtcccaaatttagaaaaaaatcacagtctgttaacaccgtaaaaatctattttaattcatcatattgaaaaaggtaaatataaacaacattgatgaatataaatttttaaatgcaagtacctaatctgagctgcaaatatcaagataattggatgtattggagaccagctggaagtgcaaagaatacttccccttggtattgactcttctctaaatcaatagcggttccaaatgtagtaaaaagcggacaagatttaacaggttctaaattattaaggccagtgcattgttgctagagagttcattaacaatctcatcaatacaatgtggttcatggacattagtaagagctttgtgtaacattttaaaacagaatgagatatctcaatggactgatcttagtaaaaaaaatttaattaggtaagaataattacattagttaaatggaacttttaattgaaaacttgttggcattttcttacctgcttcacagctgtcctttaatcatttatatttaaaaagtgaagagtttctgtacatgatgtttgaaaattatctaaacatcttggactttttgtataaacgtttaaaggagtttagataatgtggcagtaaaaacaaataggattttctgcttgcggaatggtacatttaaaagatatatatatcagaaagaaaagttatagagaaaatatgtatggtaagtatatactattcttgggaaaaaggcaaagtagtcattttctgaagctttaacatttataactttaaaacttcatgtattgaacatcattccttatgaagctttaaaatcttacagggaaataatactgtttataaaattatcttgttaaagaaaatggtatccaacaagagtttttgaaagaatgaaagcccgtatttgtgtaagataaacataaagggccaatggaaactcttattgttaaaattagtgtcagccacattttaggctgtatttactggttgttgttcaaaataagctaattggcaatcactattttttggtagctttcagcttaagccagagagcactggtttggagagacatagacatttattcaaattcacaggaacactaaacaaatggatttgttaattattcatgacattaattctggccaagacagtttcttatctgaatctcagcaaccactatcactcagtgctgcctactttacttgatcttcagaacattgctgaatttgaatattcttcctaattcatcaatttgtctcttcctttcagccctcatgggtactcaatgacacacatgtagagacaaaaatctttatatatatatgtgtgtatatatatgtatatatatgtgtgtgagatatatatatacacacacacacattactgtatagtttatttataataaactataaattcatttagaaacaagacagaggctgtactcacattccccgccccggtctgagctgctgacagatttggctcattgtatttctaggaggtaatacattctagctgtatggcaaagtgtgaagatacagatttcttcatatatatatggaaacaatatatatatgtgtgtatatggaaattatatatgtgtatatatatggaatatagatatatatatatggagagagagagagagagatgtggtcttactttgccacccaggctggagtgcagtggcactatcttggctcactaaaaattcatatatttttaaaggtatttcatcatgcagtttctgaaattttctttaatgcatttaatttgtaataaaatctctctggtagttcaaaaacataagtcataagcagatttgtgttttcactgtgtaagaggaggcaaaaggaggtaaaatgctgtaatattggagaatgactttgggtaggaaagaaagaattttagttttcttcttcgaagaatgaggaggccaggctgagatttaatgtacatgagaagtttaacagcaatgaaggtgaaacaacaaagaaaagaccataatataaatattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagagaagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaacttatatgtactcaattttttattttttggcattctgagttcaactgaattgtagcgtcatgtacataacacattgtgtagggatcaggttattatatgttaatttcctccatgctcctttgccatctagaacctgatctgctgttttaaacagcatgaggcctgttctcccatttaggctaacagtgggtgcagaagggttgaagcattatactttctaaactggttccttgttctggagagtatccatctgaagagattaccgctcttctggtgatcatcgccatcatcgtccaacacctgcctatgcaccatgtgccaggaattgtgcgaactgctttaatgtattatctcatgcagtctgtgtagtccacgcagctgctggtaaagaactctgtttcagagtaatacaaagagccagcaacagagaaagcataatggcagctgcagtgtaactgggagaattgtctctgacaattggctcccgactgggtctgagggcatttcttcatcagtccctcagttcagctagcagccaccgcacacctgctctgtgctgggcagagtgctcagtgcagtgtgccagctgaatgagtgagcaccagcctgttctccatgtgtgaccccctccttcttgctcagaggggtgggcgattgtctgtcccatttaggcttgtgctgactgtgcaagggagatcccaaggtcaggatctacctctttgcccatcactgttaatatctgtattatctaactaaagaactaacatttgtattttttttcctgaaactatctgatttttaaagtaatttttcaagcaagaaaatctttagatcatcatatttaattttcaatgataaaatgaggaaacaaggcaatagggatttttttttattattttctttagtaaaaaggtcaagtcagtgaaagatccagaattcataaacttctattctatttattagaccatgcagctctttctgctatgcactgtacctcaaatgggaattcagaaatgagcaaaatctgagatgtaggagttccagaatggatctgccacctgccagctagcattcggatctcaaaggggacctgcctgcacttacttaatggaaagataaatgtgttcaaggaactgttactataaattcatttagaaacgggacagaggctttactcacattcctctccagtctgagctgctgacagatttggttcactgtacctctggggggtaatacattctagctaaatggcaaagtgtgattgttattcagagctcccaaatacctatttcttttattgtttaaatgaactttatggttgaattcatccatttattgaaaagtacttttatacacttactacaggcaaggcagtgtatggaatactatgtgaggtattaaaaagatagacattgttcttatccaaaagatgattgtgttataaaaggaaaaacaaaaggcaagaaaaatataaacagttttattaaaactagaatgtaaaaggaagaaagaagatacaaattagtgatgtttaatttgctaggattctagatagttctagaataaaatgaaatcaatggaccatcttccaagaaaaatggtgaatcactctttaacttctaatagatgtatgagagtaaaatgtacacattataaactacacatatttaaattactcttaagagtaattatatttagatataaattattgcattcaacattgaaagcatttgtagcccaggccacgagtgctaataaacaacaagtcttgagcaaagagtgaaatattatcacaaatataaccgtgcttggtacaacagacagaataacctggaaaatactaggttctaagttctcccagtcaaaattcaatggaggtatccaaaagtcattccaaaagaatgacttctcaccagaagaaaaaaataaacatttttgatggatttttgctgagaaaaatttttagtacatctgagaaatttgatatactaacgttctgttctgtatttgtacatagtttggaattgtttgtttctattgtcttcatacttttttcaaagaaaagctatgttttaatttttgtgtaactcttgaagcacctattttagacctttacaaaggaaatgtataatgtgataggaatcagaaacagaaataacatatgcattaaacctggacattggtagcttggtaattactgcttagtatcagattattttgtaaatgaaatctaagcacatataaatattttaactattcatagaatctattatttctgttttttatatttggagatattttaattatatatataagatcaaaatattaatgtcaatttttatttgaaactttttagaacatctaatttcttaaattcttcaattatttaaaaatatgtagtgaatttttccaaagtataaggaaaatgtaagcatacatagattttactgttttttttaataccttaaagactcatcagtcatgaggttagttgatggatggaatagtactgagtgactaagcctatttctgtggcaatggctcagccatagaaattagcatttgtcactcttctgcctgtttgtctgttacacattccattcttaaaagtaatttgactaggtataagatacaccaagcaataagctagtaagaaggttaatgaatatttaaatatatttgcagacatttcttatgttcttttcaagccagccatttggaaagatcactatagttttactaaaatgtgtaggacaatattgcacaattttaaaggtttgcaaaacaaaacaagtttttggctgaaaaacattttttgtaggttaactaacttattttggaaataaaaatagcttcaatctagtctgaagtaagctctgaaaggcagcccacattccagttgacaggcgtctgaactagcagtgaagcaggtagggctgcatttagctgtcacattagccctgtctggctggtacctacctaatttgagcttctttctgctgcactataccctcagagggaacagatattctcttctagctttccattaagtgtggcccatatatatgggggtatgtgtgtgtatgtataatatataatgtatataatccatatgcatatatacacatatataattatgcttggagagataaatctctctctctatatatatataaaattgtagttgaaagagagaaaatagaacagattatcttatcttcattattgatttactcccaacccctgcttagcttttgtcttgcctttgtagtttaggatgtaaatgaccacagatttatctaactatctcatatggattttaataaccaaattgtactgatatttttagtttacttggttaaattagagttatgttgaaccctgaagcattctttagaggtagctataatgtataagaaaaagacaagatttgacttagggactacaataacttttattggaatcccagctcagagatgtattctccatggtccgtggaaccatactagcctggtattcgtaagacaccccctaaactgtgagatcttctcccactagtttcccctcctttgcccatcatagtttcagtgggaatatggcctaggggaggcagggattataattgtttagacagtgattctaagggttaggatttgcccgaatcttatttctgccaatctttcatgagacctcgaaataattactttaaccttcctatcttcagtttcctgctctcaaaaatgtttgtagtaatatcatttagaacatacggtctttgtgagaattaaatgagataatgcatgtaaagaaatcagcacagttctgtggcacagagttaaggactcaatataacttgaattaaaataattattgttttgtaataataatattataaaaatgataatataatttaacctgtgtttcccctccacttctctcttcctctgttccacccctctcttcttttctcctgttttcttccattaagaaaagagtcaaggcaaggaattatagagtcaataagagaggatgaagatttagcaaaagcagataaatcaatctctaaatttgggtgtaagagacgcctcttaggccccagcgtgaaagatacactagggcctttgccctttgaaaacctcccgagcagcaactggatagaagcaaactagaatgttgaagagggctttaaaaagtgttatattgctaggggttataagaatgtcctttgacactcatgaaataaagactaaaattgctgctttttaaacttattttgtcctctgaactaatgtttgcatcctgctcagttcaggatttgttagaattatatgattctataatttctttttgtaatctaatttgtatttgtttattttgtttttttctatttactttatatgttattttttcagttatctttttctaggcattgttgggcctctatgtaattccatacttatattttatacaatcatttataggtacttctttcttatccttatagtgatcagatttcactaataattggtcacaatcagtgacattatgaacctctgaaaggagtgtggtggctccttccaggacaacgactggaaatgtgggttcctaacttgaccattcctgtccatacttgatgatttaaattatttgttttacctcaatgttccttgggacaaataatgtttaagcttgataacctttgatttgtagagatatgtatttgggggtatactatcaatttagtgttgcctacaagagtgcttaatatttttagaaaattctattcaccagtcaccataatgtgttctggctcctgtagtagatacatacatatacacatatgcatacatacacacatacccctctggtatatacatacatacatatacatacatacattatgtatatgtgtgcgtgcatgatatatgtttgtatatgtgtgtatgtatatttaccttttctgtttctaaatttttaaatattttaataatatagtttcctggatttatgctatcttatccttcatatgttcagaaatctatttttttcatgaaattgttcctagttaatattagtaactttttaacccacctattattgaaccatattcatacattagtttttttttttctaaaataaacaacagaaatttatttctcacaattctggaggttgaaagtctgagatcaaagtgccagtatgggttctgatgaaagccctctcctaggttttggacacccaacttctcgttccatcttcctatgacagaaagagggctagagagttctctggagtcccctttattttattttattgattcttaatgtatgtacatatttatggagtacatgtgatcatttgttacatccatagcatttgtaatgatcaagtcaggctatttaggatattcactacttctagcatgatcgagtcacggtatttgggatattcactatgtctagcatttactatttctctgtgatggaaacattgcaatcctctcttctagctattttaaaatatacaataaattgttgttaactctagttaccctactctgctatcaaatattagaacttatttcttctatctaactgtaagtttgtaaacattaaccaacttctcctcgtctgtccttctcatactcaggttcccttccaagttttcagtagctatcattctcctctctacttccatgagaccaacctttccatagcccctacacaggagtgagaacatgtgatcttactttctgcgcctcacttatttcacttaccataatgacctccaattccatccatgttgctgcaaatgacatgatttcatttctttttcatggtcaaatgatgttctattgtgtatatatcctacattttctttacctattcatgtgctgatgaacacttaggttgattccatattttggctattgcaaatagtgttaaataaacataggagtgcatgtatccctttgatatactgatttcctttcctttggatacatacccagtagtgagattgctagatcacatggtagttctatttttagtttattgagtgagcaccatgctattttccataatggctgtactaatttacattcccagtgatatggtttagctttgtgtccccactcaaatctctttttttttttttttttttgagatggagtctcactgtcgcccaggctggagtgcagtggtgcgatctcagctcactgcaagctccgcctcccgggttcacaccattctcctgcctcagcttcctgagtaggtgggactacaggcacccgccaccatgcccggctaattttttttgtatttttagtagagatggggtttcactgtgttagccaggatggtctcgatctcctgaccttgtgatccacccgcctcggcctctcaaagtgctgggattacaggcgtgaggcagtgcacccggcctcaaatctcattttgaattttaattcccacatgacaaaggagggacctagtgggagataattagatcatggggatggtttcacccatgttgttctcatgatagtgagggagttctcatgagatctgatgattttcaaagtgacagtttcccatttgcatgctctctctctctctcttgccaccatgtaagacatatcttgcttcccctttgccttctgccatgattgtaagtttcctgaggcctctccagtcatgcggaactgtgagtcaattaaatctcttttgtttctaaattacccagtctcaggtagtgtccttatagcagtgtgaaaaatggactaataaagagaattggtactgaaagtggggtaatgctataaagataacctgaaaatgtgaaagtgactttggaactgggtaacaggcaaaggttgtaacagtttggagagcttcaaagtacacaggaaagtggggaaaagtttggaacttcctagagacttgttgaatggctttgaccaaaatgttgatagtgatgtggacaatgaagtacaggttgaggtggtctcagatgcagatgaagaacttgctgggaactggagtataggtctgtcttgctaggctttagcaaagagactgcttgcattttgcccctgccctctgtggaactttgaacttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaatggggaaaatgtctctaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaagggacttgccttgtctcagaggagactttggacttggatttttaggttaatgctggaatgagttaagactttgagggactgtggggaaggcatgattggttttgaaaggtgaaaagtacatgagatttgtgagggaccaggattggaatgttatggcttggctctgtgttcccacccaaatctcatctcaaattgtaatcaccatgtttcaagggagagacctggtgggaggtgattggatcacggtgttctcatgatagtgagggaattctcatgagatctgatggttttataagtggcagttttccctgctatccctctctctctctcctgctaccatgtaagacatacctttcttcccctttgccttctgccatgattttaagtttcctgaggcctctctagccatgcagaactgattcaattaaacctcttttgtttataaattacccagtctcaggtagtatctttatagcagtgtgaaaacagactaatacactcagcagcagtgtataagagttcctttttctccatgtttttggtttgcatttgttattgtctttttgtttaagaactattcaaactcgggttagatgatatttcattgtggttttgacttgcatttccctgatgattagtgataatgagtgttttttatatatctgttgtctgtttttatgtctttttagagaaatgtctgttcacatcctctgcccactttttaatgggattttttatttatttattttttttactgttgagttgtttgagcttcttttatattctgaatattgatcccatgtgagacaaatagcttgcaaatattttctaccattcaacaggttatctcttcactctgttggttgtttgctttgctgtgcagaatctttttatgtcccatatggctttttgtgtcccatatgtctattttttgttaattgcctatgcttttgggtccttagccatagagtatttgcctagaccaatgtcctagagtgttagtctgtgtttccttctagtagttttatactttcagaacttatatttaagactttaattcattttgcaatattttttgtatatgatgagagataggagtctagtttcattcttttgcctatgggtatccagtttttttcagtaccatttattgaagaacctattctgtttccgacgtatattcttggctccttttcaaaaatcagtagactataaatatatggatttatttctggattgcccattttgtttcattggtctatgtgtctgtttttataccaataccatgctgttttagttattatagccttgtaacacattttaaggtcaggtattgtgatgccttcagctttttttctttttgctcaggattgctttggttattcaggctgttttggttccatatgaattttagaagttttttttcttttctatttctgtgaagaatgtcatgatatattggtggtaattgtgttgaatctgtagattgttttgggtagtatggccatttttacaacattaatccttcctatacatgagcatggtcttttcatctgcctgtgtcctcttcaatttctttaatcaattttttgtaggtttcattgtagagttcctcatctccttagttaaatttattcctaaggttttttactttttgttggtagtgtaaatgagattaccttcttgatagtttggctgattagttatttgtgtataaaaacatggctgatttttgtttgttgattttgtgttctacaactttactgaatttgccaaatagagtttttggtggagtctttaggttttttaaaacataagatcatgtcacctgcaaaagggacaatttgactttttttttttccagtttcagtgtcctttctttctgttgtctgattgctctgagtaggactttcagtactttgttgaataggagttgtaaaagtgggcatcattgtctggttcaagtttttagaggaaaggatttcagctttttcccatacattatgttatttgtaggtgtgtcatatatggcctgtgttatactgaggcatgttccttttatgcttagtctgttgagtttatattatgaaggaatgttgaattttatcaaatgtttttctgtgtctgttgagatcacatgatttttaccctttattctattggtgtgatgtattacatttattgttttatgcaggttgaaccatccttgagctcctggaataaattccacttgatcatgttgtagtaccttttggatgttctgttgaatttagcttgctactgttttgttgaggatttttacatctatgttcaccagggatgtttgcctgtgaacatagatacaaaacatagatgttcaccagttgttgttgctgttgtgtccttgtctgcttttggtatcataatactgacctcataaaatgagttaggaagaattatctcctcttgctttttaacaggtagtttgagtagaattggtattaattattttttaaaagttaggtagaatatggcagtgaagtcatctgatactgggcttttctttggtggaagccattttattattgattcaattttgttactcttattagcctgttcagtttttctacttctttctaattcaatgttggtagtaggttgtatgtgtctaaaaatttatccatttcctataaatttttgagtttgttagtacatagtttttcataacagtcttttaggatttttttgtatttcagtgttatctattgtaatgtccattttttaccttctgattttgtttatttgggtctttcatcttttttttcttagtttaactagaagtttgtcaattttttttaaagacttttcatttcaataatcctttgtattattttttaagtctctatttcatttatttcagttctgatctttattatttttttcttctactaatactaggtttgatttgttcttacttttctagttcttgaggtgcatcattaggttatttaaaatctttatattttcttgatgtagatacatattgctataaacttccctcttaacactgcttttcctgtatccggtgtgttttgatgtgttgtgtttccatttttatttgtttcaagaaacttttagattttctgcttaatttactccatgacctaatggtcattcaagagtatgctgtttagtgtccatatatttgtagagtttcaaaaattcttcttgttattgatttctatttttttgtttattgtggtctgataagatatttgacttttgcaccttttcaacttttaaaagtttgttgaaacattttgtggccttacattgtttttcctggactgttttgtgtgctgatgagaagaatgtatattctgcagttgttggatgaaaggttctgtaaatgtctgttaagtccctttggctaaactgcagttttaatctgatgtttgttgattttctacctagatgagctgttaaatgttgagagtggatattaaagtccttaactatttctgtattgtagtctgtctgtctctttagatcaaataaaatttgttttatatatttaggtgccctgctgatgggtgcataaatatttagaaatgtcctcttgctgaattgatccctttgtcattatataatgacctggtttgtctctttgtactgttttttgacttaaagtttgttttatttgatataagtatagctattccagctcacttttggctttcatttgcatagaatatctttttttcattcctttactttctgtctatatgtgtctttacgagtgagatgaatttctttctttttttttattattatactttaagttttagggtacatgtgcacaatgtgcaggttagttacatatgtatacatgtgccatgctggtgtgctgcacccattaactcgtcatttagcattaggtatatctcctaatgctatccctcccccctgcccccaccccacaatagtacccagagtgtgatgttccccttcctctgtccatgtgttctcattgttcaattcccatctatgagtgagaacatgcagtgtttggttttttgtccttgcaatagtttactgagagtgatgatttccaatttcatccatgtccctacaaaggacatgaactcatcatttttttatggctgcatagtattccatggtgtatatgtgccacattttcttaatcgggtctatcattgttggacatttgggttggatccaagtctttgctattgtgaatagtgctgcaataaacatacatgtgcatgtgtctttatagcagcatgatttatagtcctttgggcatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactgtttaatgattgccattctaactggtgtgagatggtatctcattgtgattttgatttgcatatctctgatggccagtgatgatgagctttttttcatgtgtcttttgctgcataaatgtctttttttgagaagtgtgtgttcatatccttcgcccactttttgatggggttgtttttttcttgtcaatttgtttgagttcattgtagattctggatattagccctttgtcagatgagtaggttgcgaaaattttctcccattttgtaggttgcctgttcactctgatagtagtttcttttgctgtgcagaagctgtttagtttaattagatcccatttgtcaattttggcttttgttgccattgcttttggtgttttagacctgaagtccttgcccatgcctatgtcctgaatggcaatgcctagattttcttttgggtttttatggtttcaggtctaacatttaagtctttaatccatcttgaattaatttttgtataaggtgtaaggaagggatccagtttcagctttctacatatggctagccaattttcccagcaccatttattaaatagggaatcctttccccattgcttgtttttctcaggtttgtcaaagatcagatagttgtagatacatggcgttatttctgagggctctgttctgttccattgatctgtatctctgttttggtaccagtaccatgctgttttggttactgtagacttgtagtatagtttgaagtcaggtaatgtgatgcctccagctttgttcttttggcttaggattgacttggcgatgcgggctcttttttggtgccgtatgaactttaaagtagttttttccaattctgtgaagaaagtcattggtagattgatgggaatggcattgaatctataaattaccttgggcattatggccattttcatgatattgattcttcctacccatgagcatggaatgttcttccatttatttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtttgttattggtgtataagaatgcttgtgatttttgtacattgattttgtatgctgagactttgctgaagttgcttaacagcttaaggagatatcgggctgagacaatggggttttctagatatacaatcatgtcatctgcaaacaaggacaatttgacttcctcttttcctaattgaataccctttatttccttctcctgcctaattgccctggccagaccttccaacactatattgaataggagtggtgagagagggcatccctgtcttgtgccagttttcaaagggaatgcttccagtttttgcccattcagtatgatattggctgtgggtttgtcatagatagctcttaatattttgagatacgtcacatcaattcctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgcgggcctcataaaatgagttagggaggattccctctttttctattgattggaatagtttcagaaggaatggtaccagttcctccttttacctctggtagaattcggctgtgaatccatctggtcctggactctttttggttggtaagctattgattattgccacaatttcagctcctgttattggtctattcagagattcaacttcttcctggtttagtcttgggagggtgtatatgtcgaggaatttatccatttcttctagattttctagtttatttgcatagaggtgtttgtagtattctctgatggtagtttgtatttctgtgggatcggtggtgatatcccttttatcattttttattgcgtctatttgattcttctctctttttttctttattagtcttgctagcagtctatcaattttgttgatcctttcaaaaaaccagctcctggattcattaatttgttgaagggttttttgtgtgtctatttccttcagttctgctctgattttagttgtttcttgccttctgctagcttttgaatgtgtttgctcttgcttttctggttcttttaattgtgatgttagggtgtcaattttggatctttcctgctttctcttgtgggcatttagtgctataaatttccctctacacactgctttgaatgtgtcccagcgattctggtatgttgtgtttttgttctcattggtgtcaaagaagatctttatttctgccttcatttcgttatgtacccagtagtcattcaggagcaggttgttcagtttccatgtagttgtgcggttttgagtgagtttcttaatcctgagttctagtttgattgcactgtggtctgagagacagtttgttataatttctttttttttacatttgctgaggagagctttacttcccagtatgtggtcaattttggaataggtgtggtgtggtgctgaaaaaatgtatattctgttgatttggggtggagagttctgtagatggctattaggtccgcttggtgcagagctgagttcaattcctgggtatccttgttaactttctgtctcgttgatctgtctaatgttgacagtgtggtgttaaagtctcccattattattgtgtgggagtctaagtctctttttaggtcactcaggacttgctttatgaatctgggtgctcctgtattgggtgcatatatatttaggatagttatctcttcttgttgaattgatccctttaccattatgtaatggccttctttgtctcttttgatctttgttggtttaaagtctgttttatcagagactaggattgcaacccctgcctttttttgttttccatttgcttggtcgatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgatagctggttattttgctcattagttgatgcagtttcttcctagtctcgatggtctttacgttttggcatgattttgcagtggctggtcctggttgttcctttgcatgtttagtgcttccttcaggagctcttttagagcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgccgttaacattttttccttcatttcaactttggtaaatctgacaattatgtgtcttggagttgctcttctcgaggagtatctttgtggtgttctctgtatttcctgaatctgaatgttggcctgccttgctaggttggggaagttctcctggataatatcctgcagagttttttccaacttggttccattctccccgtctctttcaggtacaccaatcagatgtagatttggtcttttcacatagtcccatatttcttggaggctttgttcatttctttttattcttttttctctaaacttcccttctcgcttcatttcattcatttcatcttccatcactgataccctttcttccagttgatcgcatcggctcctgaggcttctgcattcttcacgcagttctcgagccttggctttcacctccgtcagctcctttaagcacttctctgtattgtttattctatttatacattcgtctaaatttttttcaaagttttcaactgctttgcctttggtttgaatttcctcctgtagctcggagtagtttgatcatctgaagccttcttctctcaacttgtcaacgtcattctccatccagctttgttctgttgctggtgaggaactgcgttcctttggaggaggagaggtgctctgctttttagagtttccagtttttctgctctgttttttccccatctttgtggtattatctacttttggtctttgatgatggtgatgtacagatgggttttggtgtggatgtcctttctgtttgttagttttccttctaacagacaggaccctcagctgcaggtctgttggagtttgctagaggaccactccagaccctgtttgcctgggtatcagcagcagtgtctgcagaactgcagattttcttgtaccgcgaatgctgctgtctgatcgttcctctggaagttttgtctcagaggagtatctcgccatgtgaggtgtcagtctgcccctactggggggtgcctcccagttaggctgctcgggggtcaggggtcagggacccagttgaggaggcagtctgcccgttctcagatctccagctgcctgctgggagaaccactgctctcttcaaagctgtcagacagggacattgaagtctgcagaggttactgctgtctttttgtttgtctgtgccctgcccccagaggtggagcctacagaggcaggcagacctccttgagctgtggtgggctccacccagttcaagcttcctggctgctttgtttacctaagtgagcctgggcaatggtgggcgcccctctcccagcctccctgccgcgttgcagtttgatctcagacttctgtgctagcaatcagcgagactccatgggcgtaggaccctccgagccaggtgcaggatataatctcctggtgcgccatttcctaagcccgtcagaaaagcgcagtattcgggtgggagtgacctggttttccaggtgctgtctgtcacccctttccttgaccaggaaagggaactccctgaccccttgcgcttcctgagtgaggcaatgcctcgccctgcttcggctcgcgcacagtgcactgcactgctgttctgtgcccactgtctggcactccctagtgagatgaacccggtacctcagatggaaatgcagaaatcacccctcttctgcgtcgctcacgctgggagctgtagaccggagctgttcctattcggtcatcttggcttctccccgagatgaatttcttgtaggcagtatatagttgggtcattaaaaaaatccattcagctagtcatatctttcaaatgaacaccttattgtgtttatatcaaaggttattattctttaattgtttttgtttgttttgtatatcgtttgttcccttctttctctcttattgtttatcattgcggtttagtggttttctgtagtggttccagaatttgtttggttcttttatatgatgtctatctctttatggaacttttcattaatatcctgatttttttttctttgtattgtttttctgtgttctctgtgtctcattgagcttctttgctataattattttgaatcttttttcaggcatttcatagatctatttttcactgaatattttgctgaataattattgtgctcctttagaggtgtcatacttcctggattttttatttcttgtgtccttttctgtccttatgttgatatctacacattttgtgtaatagttgcttgtttcaatttttttttttttttttgagacggagtctcactttgtcacccagtctggaatgcagtggcgccatcttggctgactgcaacttctgcctcccgggttcaagccattctcctgccttagcctcacaagtagctggaattacaggcccacagctaccatgacccactaacttttgtatttttagtagagaccaggtttcatcatgttgtttaggctggcctcaaactcctgacttcaggtgatccatccacctcggcctcccaaagtgttggaattacagatgtgagccaccatacccggccagcttttttcaatttttttggatggattttcataagggaaaatttttcctatggatttatctatggtattggttgagggggcactttcgctttgattatagggttagcagtagcatagtcctcatatgatttttacagcatcagtggtgtctgtgatttccgtttcttagactgtgattattagtggagactgtgttgaaattttactgggtgtaggagtgccaggtagttcagtcctgaggcccagtggtgttatcagtgggctaagtgtgcctgtctttaggctcctgtgtggcatacaagggcacgtgtgttagtgggctcaggtgggccaattgttgggcctccaggaagcttgcttcggttcagtagtggcagcagtgggcatgtgtgtggtgaattcctgggcccctaagcagtatgcatggcatgagaaatagcagtagtgatggtgggaccacccttggactctcaggcatcacatactggtgtttgcagtgcctgcaacaggctggatggaccagccctcaggagaagtgcacggacaccagcagtggtgaacaaggcagggctgttctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctaccttttcttattttgcagtgcattttcattatgtatttatgaaaaaattatatagagatttatgcattcaagtgcttgttgacatttgttacattgtgtaactacaaaaccaccttcactactttgcttattaaccatagagtgttgagtgagaaacccagagaaaaggatataaactttggacagattatatggattaaatccagctctacgtctatatgctatggtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacatatttgtgagaataagagaaggcacatttttgtgagcattcttgtgagaataagagaaaccacatttctgaagcactagaattttcacacggtttttcaaaggaaggagatttatagacacacaattttacaaagaagacaatagtttaatctgacaagatattaaatataaatagaaaaatctacataatatcaccaaaacaactagtctaaaattaaaaccaaaaagtaccccaaactggagaaaatatcatagaaagtatttcagaagttctgtttattgatttataagtaaagatattttaaactgggaaatccagaagtagtttgatcagcgacttttagattacttgtacctttttctcaaggatttatattttattgttacagacagtagtctcaccattttgcccagactgggctcaaacttcagggctcaagtgatcctcttaccttacccttccaagtagctgggctacagatgtgtgccactgtgcccagctatatttatcttatagtttaataatattatctaatttttataattgtacttaaaataacagatttcaaagagttttattagcaactactgtgtcctgatcttgaaactgaaactatataccagaaaagattttttgatttttaattaggcaaaattattttctagcattgtcatattaaataaggttactactctaggatttttatgtatgtcctgttagattatctatatgtcagtaagtcatgaaaagcaattttcatgaaaacttggaattagaaatattatagattgtattcttttagttattttttccataatagatcaacatttttatcttggcaataactgctatagtttttgtaatcttcctcatacattacgtgttaatcttaaaaactgtggaaaatatgaaataaaaattttactcatgattaattcacaagagttaaacattattattttattgtgttttcttgtttttgttgtttatatagtatgtagtggtggccaaaagcattcctgaacagggagggtgggcttccccacttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatattttttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaacatcgtgaatttatttagaaatttccctattttggtcattcagtagatttccactctttttttttttttttctaaaaacaaaacaatggatatgtagccttcattcttagctccgattttcttaatgctaattccagaaagaggaattactgggttaaaataaacataaatatttttaaggctctcttacgttttgtgctgcaaaattaccctttctgttgacagttatatattttaaaacgctcaaaatgtatcttcccaattctgttgatgatttttgtgactacctgtgtaatatatgtaatatgtcctctgaatattaactcgggtcagagacaaatatcagtcaaatcctcaggctcaggatgtatgcctcaatgaacactactagttttcactatgcatccttcagggtatgtgaaaatagtcagtagaatttataaaatgaaggtttggaatctgagttattttcccaagagatttatgaactataaaataatattattatgttctcttattgcattgtgctctttagccatcttccattttatgtggtatagctccttaggatccatttggttgaaagctactgtgtatactcattttgtattgtattgtggcaaatgctgtaatctacagggttcctattcatttcacagctcactaattgtgtgaatgagaagaggaaatatatgcttttattctaaagcatgccaagcagatggccaaagttcattactaggagcattgtcagtgtggctgtcttttctaggtagtaagcctggcatcgatctgtcaaacacagagtgagggtccatttaacacagcacttgaaaatcactgagcctctgttttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaactaccatcatttctgagattgaaacttttgaaaatttaagttgaagaaaaagatcagggtttatatctttttaaagctaaaagattaaaacaatgaaagaatttaaggttttaagtaagtctcccttaaaatcttggtttcttcctataaaaggaaactgtttacttacttttatatagaatatgtaatttatgtgaccattaaaaatgttagcaatgtactcattgtgtgtgtgtgtgtgtgtgtgtgtgtgtataagtgagacagagtaagaatcagagatagtgacaaaaaggaaataaagcctgtcttcatacatgtcctacttcaacggcagtactaggactatatgtaattgggttatttcaggaaaaggagggtaggtcaaattttcttatggagctgatgtagtaatttgatcataatgtcttgtttaagagaacgagagcatgttagagataacgttttcttctttatacaaagaaaaatgggatatatatttcccttacctcttccctcttcctccttgcaaaccatctaccacaagttctacaagttatattgactataaatttccctttcccttgcttttcagactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggtaagttaggagaagaacatctgccttgtctcttttgttgtcaagctgaatgaagtgagattattgtggtttttctagcaagtgtccttttactttatgtttaatttaaattttctctcttactccaaataagcaaaattaacatttttactaaataataccaaatgaaaggtgaggggaaacaaaatatctatcaaagtatctatgagggttagcatttacctttctgaatctttattacttttcctttatgtagagatatagattaataaaggaatgtttatattttaggcaacaaaatataaaatgcatttttaacataaatgtcatttgcactacagcaaaattatacctaatttgtgaggcttcaagtatagttattcagattaattgttcctaaatatgtctagttatttaaattatatttacaattaacaaaaatagaatgtatggattaatcaaagtgcaaaatttactccatgttatataatgcaaccattcttatgaccatatatcatttctgactatgtctgttatagatcaagaatattcatagtgagaaaaagtttttgaagatcatacatacatacatatatacatgcatatatatacaaatatgtatacgtatatatttttcctgtcaaaaaagaaagtcctttgttaacttagaatacttttcatagatgaaagtttaactgtgccttaatctttgcaatgaaatatcacaggtattattaccatatgaaattttttattaatggcttaaaataaatcatcagttcatcttgtaataaattattcatcatgaaaataaaagtgcaaataggatcataattaagtatctctgaatatccatgaattttctttgtctaattcttatcaaactctcaggtagatgaattaatagtttcgaagaatatgcagtttattagttgccccatattctaacatttacttctggtttaaaactgaaacttagtgagctgtagacacagtccacaggtctggcgagatgaagaattgatttttctgaactcagcactagattattgaaacaatgacgtgtcaagcagccctaaaagaagcagttgtatgacattccccattgtatttattgtagggtgtaattgagaatcttgtccactaaatcacacagtgtcccccttatgaggaccaacaggagaaatttctctcaggtctcagtgccaggaaaagctctttctcctgagcagctggtatgtcttaaattatagaccctgtatattgtgtttttatcatattttcttctttgttttggttgctaggaagttcagaattgaatttgtgataaaattacttgtgcaatttcacctggtatacatttctttatgctctctctaccccagatttgttcttctgttttacacttctattcttgtacttcttgatctttttgtttacttttatactattgtccattttggttagtcacttgaaagtttttctttggaagccattaggctaaaaatatttttttcttccttattccaaaccagtgaacacatgtttaactttagcaaagacatgttgcaatatgtttatgaatatgtattaaactttttctatttcatttgtaatttattagctgaaaactaagaatcttgcacataagtatccaaatatcatatggagcctcagaaatttagtaatattaatttcaaatccttattgaaatattacccttaatctactgatatttacttcttttgggtcttggttatattattttaaacattttagttgtgagtatacattttataattgaaaatttctgtatttaactactttttcctaagctatttccaaatgacaaacaatggaaaacatctaattgtggttctataaccaacagaatgggaaaactttttacgttaaaaaagtccagatatttactcaccttttagggttgaacatattatacagctagattattatattcccatctcctccatgaagtatatcttgatatgaagtaattataatacatttcccttgcccttacttagtggaaagctagggggaatgtatataattgagttagtataacatagcttttcctggattcagtttctcttattgtaataagttccttttcatgttattatgaatttagtagtgggattttataacagtagttctaactgtatttgccagtgagatatttaatatctcatacaccataaaaagtaactaaattcttctcactttagttaaagaggtacactacttaaaacataataatacaatgtctcctagacagaaaattgtaactggaaaatgcattgtataaaatgaaaaatttatagtaaattttctgctgaaactaggataatttatgtagaaaaacatttttcaaatttcagaagaaaattaaaatattttaaaaatctctagcaatgtaaactgaaaagtaatgaatataagtttcctacttttgtgaaaaaatgtttattccatctttcttcacttatttattatcaatgtttttctattcccataggcacattgggaaggcctcacaggcagaataactttcaacaaaaccaatggcttgagaacagattttgatttggatgtgatcagtctgaaggaagaaggtctagaaaaggtatttcagtgagcttatttgctttaattactaaatgaaacatatctcaaagaagacaaatattctctgttgtagtcacatttcattgacatttaactttattgagtaactctaaaaataaatagttaattcattatattgaatataataattgacaattaggattcaaggataaagggtatcttaagacaattttatattttattttctaactagagatttttctgatgcatataatgtttgaagtgcatataatgttaattagtcttaaggtttaatatagcaattagaaaatatttggtttaatatgggtctttatacatgcagcttataatcacttatggttgcatagactttccaacttggagcaggccattaagaaattaaatataaaagtatgtttctattttttgagtcatatttaagtgaaatatttgaattcatgtatgcacagtaactagggtatatacataaatgtaacataccacactggatctatcttacttgattttattgctagggattgtggtaaaacacccaaagaatgtgggtatgtgcctacttaatgaatattttagtgtgagttttcttaaatacataatgtatgtatttagatatttttctgatagattcattgataattgacaagagatattaaatctttttatatgttatttagatgttattaaatcttattagatcttattaaaataagaacttgagaaaaattatatgtgactgagataatattgctttgaagatagtaagctatcttatatttcacccagcaatgaaacatgcagctttatttctagacagaaactgaagaggaaagctgagacctacgaagggctttcttagtctggaagataacagcatatttgaatgctgattcaaaccatccaggacagagtaaaattgcatttttgatagtgtccccaagacagttttaaatacattatgaccaactgatgactcaaactgatagagctgttacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctgcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctgaattaattatgttcagtccttatcctcaaggggcttttcatgtacagtgataagataatacatatttgtaaataaatacaatcaaaagctatatgtttcaagctttcaaaagaccaataaaaatataatttctgataaaagatataattaatcaagagtcatagtcaattgagtacttagaattagcctttgaatatgttgaattattgattgttagaaaatcagtcattttagaaggaagtagaagtatggggaaacacaaacatagcgtttgattttatcattacacacatacacatacaaataaagctaaaatgctagattttagtcataacatagataccatgtccaagatatttgcagggtattagaacacaatgtgagtttaaagaaagaatagccctgaaggctatgggttacttgggaagataatatagtttagaataattttagtatgaggccatgaatttaaaaccattctaataggaagtggagatgagtaaacagtttgtgacagaaggcattaactgaaccatcagcaatgttgttagttcaaagactagcaaagcatttggactatgtttttaaggagaaatggaggagccaggtaggaaaagggagataccagggataaaagcataactcaaatattggaaaatgaattagcaagtaggggaattactagtagaaataaactggcataaaccttcccctgaaaagacagataaggtaccgaggatgggtggaggtaagttaaagagaaagggagcaaaaagttcacatcacatgttttcaatatccttgaaaatttgtacatgaactcatcagctaaaggacagcggtaaagtttagtcggttcttaagaaaaattgaaaattccattttgacagacttgattttgacttagaaggaacaaaatgctgctaagtagcaaaaagtcctcattttaaatttagtagaatagtttacagctcaaggtctagattcagagatattttggctcaaattctcactctgccctttactttttgtggacaaatttattaatctctctaaaacacagcgtcttacactgaatcatgaggcaacagcagttatctgcctcatgatgactgagtgttattgacttgactttttttctgcctagaaagtatagttaccaacccatagatggaaaagacagcatccctaccctgatggaattcacagtttagaagggccaatagatggtgatccaagaggcttgaatttcagttccaattctatcaaaactaagcatgtgaacttcatcctgccaccgaacttctctgtgccaaattcatcaccttaaaaaaaaaaaaaagtgcagggcaaagggctgccctcttggacagtctgaagtgagaatactatggcctctaaaagaacccggaagtaccatcttgaaataaattgatgctagaaattttaatcgttaaaatttaacaattatgttctatcatgactgagagacaaaaataaagaaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtcattttgtttttatgtcactgacatgatagattttacataatgttcggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactgtggtcccaaaaagatcaccgatactgtatacacagccagccacttctgtgcaaacaagctctctgggaccatggcagtgccttcaatggaggaggggagggcaagaagggggaaagacagtaggtactattacagactttgcctagttcaggcaatacttttgcttatgagaggctggtattgagcactcaggaacaggaaaaggaaaacagaataagtgattttccaagcttgaattcttctggtcagttcaaggatcatatagtgtattctactttcaaaatatgtttagaatccattcatctctcaccacatccgttgctgaatcataaccatagtacctttcaactgtacaactacattggaattcccacaagcctctctcttcaattctgttataatccattccctaaaccacagcagccaggcagatatttttaaaaggaaattgacccctgtcatccctctgtttaaatgctttcatagattctcattgtgttttgaataaaatccaaagcaccagtgacctctcatcatgtcatcatgttctcagatattttcttctgccctacctacagagggtttttttttttttctcatttcctcaagaaaacaaagttttcttatcactttggcatagagtaatagaaacagttttcccagccaggaatatccattcccagttcctttgcctggggaactcttactcatcctggtagtatcatcttaaatattacttccttagataggcctcctctaagtctctaatcaagtttaaatttctcctaatgctctgccctttttaatttctgactctatcaaagtacacaattatttattcacgtgaactttataaaagggctatctccctagccagagtgcaagacctactagatggaaaatatatgctcccttttccactactatatattaaggctttgcaaagtatcctttgtcttgaggacaaagtatgtactcaagaaatatttgttgactgttgaatgaataaagaatctttatggaaattatgagatacttcacacagaacgcttactcaagtgtctgatgcagagttattttcctgtagcacagtttgttgcttttcctagctttgctctatacctccaacatgaggacagggaaagacaatagtcaagggatcagtgggttggggtcatgggtcaatgtttcaagtgggtaaaggattttagattgcagaaggtcaccctgaagtcggaaattgtaaggatccacattgcttcagtggtaaatctggccccattcatggcacaattaaaaactctctgaccttccagtattacattaaacagtaaaactcaacattctatttataaatgttccttttttgtccttacaagttacagtatggaaataaacaaagctcacccaaatgagaacaagtggaagttactattcagaacttactacaggaagggagacagccttcatcacttgcattaaacagggattcaaaggcaagcaggggagtggaaaagtttcatagtggaaagaaatgaagacctcaggtgtgctgtgattggagattgctggcatgaggaaactggagttggtctaacaaagcagggcacctagataatgggttttggggggcacatttgactttctctggctggttctgatttggagggtggcaaaaaattgggaaactggaagtaataggatgaatcctgattgttttgggtagattgcctgctgagattgtgtttggcttcctgaggtgctcactccagagcttctgggtcatagtttgtcatcacacatggtttggtcattgtctatttgtgtattcagtctgtgagtggaattactgaagtaatttggagggagaagaatagcaaaaataaaaagaagcaggaaaaatttacttgtgaggaaatataaaaacatcatcaccaacaataaaattgtttttttggtttgttttgtttttgttgtttagaatgtgtaaccaggatgtaacttattgttggaagtggtttatccttattgttccatcacctgaagcttagctatgtgcttaggaaagaccagctctagagggaagaaaacacaaaactgatggcataagatgttacagaaatattcaggaagatcttagactgtaacttcaaaaggatatcatttacagcaaaaagagttggaagagttccacacaaaatgggtttagactgagttgatgacattatataaaatagtgcaatttcattgcaagatgagctacctagaagccatttttgggaaaacaaccacttaaatttagaaaagaatttcctataggaaactgtaatgcaataataaaatccctgaatcttaactcatgattgaattttcttttaaactctcctatgtgaccacaaagtacttcgtgtgttttccaagagaaaaaagtcagtcttttactgttacactttcctggttattcaaaataatttttattgtactacagaatatttgtttctaagtacaggtgtaaattaaaattattcttgtgtacttctcttatcctttttctagcatcaaattttgccaatctgattactttgtggatattctcctgtgtgatatttaaatgaaaatagacattggagaatagaattccctatctcctcagcagataggctctaataaaccattattaaaattggctttatgtattaatattatattaactttgaaaaatagaaaggataaaactgataaatttctttggacagaaatagtgctgagggaccttgaagcatttgggactataaaaaacaatcacaatgtgtttgccccagcgtaggtttgtaataaaatcagatttagtttgtgtatcctttgggaaaatcttaaaaaaaaatacagaaagacattttatgaaatatatgtttgtcaatttctatagttaataatataaatataaaaataatttgtaaatgtcttataaatagtatttataaataatataaagcaatatattgcacatttacacacctctaaaaggtttaaatttgtcatattttactttcatgtgaagcttcattttaacttttaacacttatgctttttaaatatttactgcttgcatccaccagtatagagactagtattaatccacagactttttgctaaaactcaactatcttgataatatatgaggaggataagaattgatagtgaaaccctgcctgcctgagtttacaggcttatgtgttctagaattagaacatgtttcaaagtgctttttgaatattttttgtaaagtatgtattttgaagaaaaagtggttatttctacagaaatctttactattgacctttcttttacttgttgactcctgccctcattaaacttcatatgaaaaaggtgcctgaatggaatttaaattttctgaacttatctaaatctgaaaatctacctcagataggtgaaatttacattaattatagatttctagaaccggatgcacggcagtttttatcttcctctctttggtggcatttgatacatatacccagtgcccatggcaacagtgacccccaacttgtccaggaactgagatttatcttgccttcctctacgaaagcaattttaatggtgatgttaactcgtaaactttaaattagtcaaaaagtgatgtttgcttctctaaaaacaaaaatacttcctgggcaggatccaagcctattgcctttctttggagatgttagccatttaatttgtctaactcttatatagaattcattataaaccctgtctcagaactgtaccgacatttttgtgtgtcagtgtgtatagttattattttgtttggcaactttacactttcaggacgataaaatatttcagaaaactatttatgaatgatgtttatgtttagaaatcaatcagattgccttatttgaggtcacagaatttattgttttggttcccaaaaagtcttattttggcccaccaatgaatattaaatattggcttttttcttttaaccactaaatttgaattaacatatatatatgtataaattacaattatgatatatataacataattgtaattgattgatttgatttcaaatcaaatcaaatctgacctacatttttatctgtggaaaaatggcttttaactgaatggtatcgtattttcatatttgggaacatgtaattcattaattcaaacattatttaaaaaatcaaaatcacaacctgtctgttaactctttaattgtgcttagcattaaattgccctaaactaaaataaaaatcttaaatgagaaaaatcagtgtttagttagattattaattcctttccatgagatgattatatacttactgatttattgtactcatattagcactatagttctcgaatggtaaaatccgagatcctatgcacactagttgagagtttcaggacgctgattacgaaagcgttctttgccctatccttataggccaattaacttatatctgaaggtcagccaatttccagacaattgctctggactcaaattctagctggcaggaagcacataggctttgctgtaaaatatttctttttgttttctagagctcaggtgccaatgcttaagtgctctcttttcaacacttagttcaatggaagtaaacagttattaaacttcggtgtcaagggttattagacggtaatgcaactaactatctctacttttcatttaactattcatcatttgaaggagtgaagtaaggaaaacaaaagtctctaatttcccactaatagtgagaaaactaatctgttgaaaaaaatttctgtacccaatattcatgcattgtattggcttgagaaacccaggttttcagaaataataggtatatgagttaatagagaaataaacagtccactagtgtatattcagtcaattgcaggaaacatctttcatacgtaaatcagcatttaatataaatctctttcttatgctttctatttctcaattccctcaaacagtactatcggggtgccaacttttttccaagggaagtagtcaatatacttcaaggaaaactatactttgtaggtcatatggttgggggcaactcattactggaaagaaatttctttaagcaaacatattctaagatggagagtctgcattgtgctaagactgttggaaacccatgtacagtgtggtttctcattatcatcacacaggatctctgtggaaaactatggcttatattctttattcaaggctgacacattctcctgacattaagtcaaaacaatgtacaatcaaataactttcttttttacatttttacattgttgtctaatggaaaactatattgcttctttttccatctaccaacatccagtgaatattttgtgagtcaatgccagtaagaaagtataaagagaattttgatagatttgtatcaggtattttttagtggagaatttaaattatttcttaatttaaaataaatttaactttatttggaactaatatttttaaaactaactgggaatgtttattttgttcctacttgaaaaatttcttgtatacatatcaagcaaattatttccataaatttcatagaaaataagaaatgtgtgacattgatccggtgtacacaaaacagagctaacatgcatctttagaagaaaagatgctactttcagaggttaacaattatatagcccaatagaggaaatagaaacattttttggatttaaagtagtaatatgagttacaaaacaaaatttgtactgagaaaactgtcaccaaaaataaacaaataaacaataaagaagcaactaattaataagataaataatttaaaaattattctgaaaactgttgttttctacctagaaaaaaatacacagaaaccaaagagaaaatatacttataaaacaaaattatatgaataatttacacattcctgaaaaacaaaacctatagtgtaaaatatttatttaaaatacttataaaatataattaggaaaaaatggaaattcatagtaaaggtatgtggcataatatttcaaacattaaatatgatattgagatagatcttaaaacattaagaataacacaaaaaacatgaagataaaatatggaaaacaaaatatgtaattataaaagaatagacacatatgtatgttcaacatttgccaaatgaatgaatgatattggaaagtcaaccaaaaaagtctgaaagtttttatcatggagtaattcactcacttactctatttatttattcaataaatattcattggatatttattatataatttaaagattgatgaaatgtttcgttttgtgaaggcacttagagtttaacacagcaggatcaataaaaatgaaatataatttggattcaaagcaatacataagtggcatttctgagatgaggaaaataaaacatttatttctgttcaataaatattattatttatgttcaataaataaaacgtttattggttatataaccagtatgttcagagatctcacatataaagcccgtaggatgtcctatattcaaaggccttggggtaaaaagatgagtatgccaaagtctccatccgtagggaattagtttttactagacagagataagtaaacagttaaaatataatatgatacttattgtagtaagtaaaagcataactaaattgctgtgtatggaagcgtaataaacgatcatccattactgcacagaggaggaattgttttacctatattttgaaacagtaattaagatacatgcataaggtagtgaaaagggaaagagtacaccttctatagaagacatgaggacacaaataattgagaactacaagatgcaacaaagtctatgttcagaaaatggagaaatgcattatatttctgacaatttaagaaaagaaccattgtttctctctctttctactcagtctttaggtaacatattttgcaaaaagttcatatatacatgatatacacatccgtatataacatatacataaatgctatgtatgcatatacataaatgtactatatatagagatacatgcatacatctacatagacatatgtaaacatccacatatacacacacacacacacacatatacacacacatatgtacttgttgagatttaatatttccaaatgataatactgaagactttcaagaaaaaatattcaccaatagcaaaatacatatgaggtagctctcagtctttttgagcaacattaatactagagaaaaatgaataaaacttagctctgaaggaagacggctctgatataataggtcttcatttagctaagttttctttatataagaaggcagcaaaaatacctttaagtctgcaaccataaaagtatgtcacataattatcttttataataaattatcttgtgtaagtacaatgataagtgaaaagcaaatactcagaagaaactgtggctagatatcctagtaaacatcaaattcagttaagcacaaaaaaagatagttttgaataatgactttacaaattatatcaaaattacaaccttttccttgtagcaaaataattcataatacacaaagcaaaataaagagaggcagtgtttacaaccccacattaaattaactaaaaccggctgggcacggtggctcatgcttgtaatttcaccactttgggaggccaaggcaggcagatcacctgaggtcaggagttcaagaccagcctggccaatatggtgaaacccatcttttctaaaaatataaaaattagctgggcatggtagtgggtgcctgtaatcccagctacttgggaggctgaggtggggagaattgcttgaacccaggaagtagaggttgcagtgagccgacattgtgccagtgcactccagcttgaaggacaaagcaagctccatctcaaaaaaaaaaaaaaatgttaactaaaactgtgaatcagtatgtgtggcagcagaatgggacaaagcatagataattttcgtagagtagatatttcaatttttatggctgaatattcgtttttcagcatgatagtaatatttcaaacagaagctgataatacacattagtagacttaaatgtattttatctcccaattaccataggaaaatttccaggagtagaaagtaaataataaacaccaaacaatgtgaaaggagcaaggctaaataaagataagattcagtaagagaaaaagttaggacattgaaaaaatctactaaggcactaattataaaaaaatccaacaaaatgagaaatatgttgaaagtgaaaatatatataatgatttatcagcaaatgcaaagaaacaaataatggaggtaaagtaagtgtgattaataatatatattgagagtttacgtaaaacaaagtaattgaaataaaaacagttatttttatcaataacaccatctacagttaaaagacttgacaattataaacctttataatataatctgatgttattcaaactattaaaagctaaattgttatacagttgtcttatggaaactaccatgaactgtaaagggaaagataacaagtagagaaattattttggaaagttatttggcaacatatagtaataatcttaacaactcagattatctgtgctcagtcattctaattctagaaatctgtttttaaaatgataaaatgtgtgaacaaatatttataaataaatgtgtttactaaggccttgtaacaatgatagttgaatcacgatatgttcatatgatcattttgtgtagtcattataattatggatttgattatctttggtgccaggagaaaatgctcacaatagtgtataaacagaatataattagtaattgtcataattatagcatacttataaacacactatgttgaatactttttcatttaatcacactatgttgaatactttttcatttaatcttcactatagtttatgaagtagatactattatttcccatttacagatgggagaattgtgacacaaagaaataatgtacccgagtcacctgatgttaagtggtggacataggatcctggcagtcaaatacgctgtccataaaagctgggccattaacaacaaggctatgatggaaactgtgcaaggaatgtgtgtggaaagacaaatgacaggaaaaaataggaccacaatattaaccatgattgactctgggtgtattcataggatcaaagtttaaattgatcttcttcttatatcttctgcatattttataatctcatgacaattaatatgcattctttttctgaccacaagaagaaatcaaagagccaatcagaacataaaataaaaatgaataaaatcataattttctatagctccttatgacttttgaagcactttcatatttcttgtatctaattgaatccttataattagaatggccctataatttattacacaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttttgaatcatgtagttgacaatctaggaatatctaaaattttatttgacttaaaatattaaagccactgatatttctgaaatgtcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcagatggtaagttgagtgaacatttagctaaattatttttataaaagtaataatggagggtggcattatgtgaaatgggaaattctttgtattagttacttggttagaaagttgaaaactttctaaggttttattagatagacgacagtgaacaaatgatgtttgtcagtggtttcactggtagcattacacatctgaaaatcttagctattttgccaatttatattaaaaaaaaaagtaaaatctaagggaacaaatgcatgataggtattaattatggaccaggtatagaaaagtgacagtcattcactgcaaaatactatctgcagatgtgtcttgtttagccaagagtatttgcaaatgattttaaatttgaaacactttggccgggcacagtggctcacgcctgtaatcccagcactttgggaggccaaggcaggcggaccatgaggtcaagagatcgagaccaaactggccaacatggtgaaactaaaaatacaaatacaaaatactaaaaatacaaaaattagccgagcgtgttggcgggcgcctgcagtcccagctactcgggaggctgaggcaggagaattgcttgaacccgggaggcagaggttgcagtgagcagagattgcaccattgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctgggaacatgcagccccaaggcacacagctgttggaaaagcaggattgggattgtggcccctcctttctactgtgtcttgacattttgtgagatttaaaaattgcacatacttgcatagaaattcttactacggccctgtacattatcatgtttcacattgatatgaccggcttggctcctgaagcctttcattattgactctgaaatagaattaggctccatctttaggacattgtcataagcatagtctaatgtaaagaaatgtaaattggccagtaggtggtttagtttggaaagaatactgaattacttgactttttccttcctaacaccaacatcaggaatatacagaatttaatggtgagaggaaaattaactccatatgaggaaatatggcaaagagattatgctgatgggacctttgttagcatatttagttagaacagagtaaataatacctgctaaatcaatgccattttaaaaagacttaatttatatacaaagacttattttaaagataatttgatagttttccttttctttgagaaaaataagttggatacttgtctaggagagtatggaagacaaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaatggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagctcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaagccagcgaacatcacagattccttatccaatcgttctttgattgttaccaccattttggtaagtatttgcttttccattattcttagttaaatgtagatgaacacagaagtgcatagaaaaggacattataattggaacagcaatgaacagaatgtattttacagttatttagcaattactgtacaacagatgagtcaatgttaatttagtcacagttttgttagtcttaaatgatctaaattgtattaacgtttgggctgtttatgttgactaataatacagcttaatgtattactggaaatcttttcatttttccaaaattagttactattgaggaattgtcaatgtcaagacttgaaaaatacgtgcagctctataaatatagttaagtgatgagccaaaagtgaactttgcttctgcttttattttccgcaaatatatttcatagggcatggcacttatttttcagaattttttctcattataattatattttaactttattttcaattttattgttttcatcttggaaaattaattttactttatgaatttccctaatgtaaccaaatggcaagtgctttttaaagccagaaatattttcagcactgacagacttaatattgttaagctagatgtttttacccctcttatatttatttatatcttttaattagatcacacagtaatgttcgcttatgcccactatgtcatttgcaaaagggaattttaatttaggataagcaaatagctcttacattatttagtcagtacttttcacctaccaaataagcttatcaatgaccattcttattaatcctcaggtagtcagtaaaaattgagagtaatatctagaacaaactaccatgaacatttagcatttatataatttctaaatttgatttatggtgggaaatcaagctatgaggaatatatattcttgcccctttagtagcaacgagggatgtcagatctgtaggcatgtcaaaatgaagtagcttgggttaaagccttttgataatgaagcaaagctgataatcatgaagtgacagtgatgaaagtcataaagtttttaaccaatctgtggctaaggacctcagtggatactcgctctctctgtcacatccaaacgtctaagacacccttttacttaattttctatcttcctttcttttcaaagataactcccatacccaccaacctagccctcttcttcagtcaaaatgttctcacagtacaattacacatcctctttctgatctacatgccactatgttctggatctcattacttcctgttgggactattgcagtagccacgtaactatttcttctgcctgtggctttcctcctttgcagtgcacccaagtcccaccataaaagtctaattctgttccaggcaaatggtgactgcttgaacaaggacaacatcaacaacaacaacacaacaacgacaatctaatcctgtcatttctctacttctttgttatacagattgttagagaatccttattgaccattaaaaagccaacaaatttaaatttttatatatagggtcctctatggtcttactctctctcacctttttatcttcacttcccattattttctttcaggaaccgtgtgttttaattgaattgggataaccagttagcctgctacatagttttgtgaatgctcttcccttgctctgcaatatgcttatctcaatttctgagatatagtattcatcagtaatatatgacttaatattcatattatgctattcttatttcatgtgtgcattattttcccaaatatcactaaacattccttggaggaatagaattagattatgtcttctgtttctataccatatgtacctctgcaatgatcataggatcaataattctgggtagaaaacatctgtagccttcagtaatctggcccctacactcctttctatcatcttcctgatctagccaaattcctcaaaacatcacttattttatggctccaaatcttcgctcaattcttcttcttctcctcctccttcttcttcgatggagtcttgctctgttgccagtctggagtgcagactcatgatctcggctcactgcaaactccacctcccaggttcaaacgattctcctgcctcagcttcctgagtagctgggactacaggcgcgctaccactcctagctaatttttgtatttttagtagagatggggtttcaccatattggccaggatggtctcgatctcttgacctcgtgatccgcctgcctcagcctcccaaagtgttcggattataggcgtgagccactgcacccagcctgctcaattcttctttatgttctgcagtaaaaatcctattcattttcttgtatccatctcaaatgctacccacttcatgaaaatctttgacagctccattaagttgcctgtgtcttggggagaaggaggaagtttgtatactttatgtaccagaatactccatcatggcattatcatttttttaattaaaaaactatgtatgtttgtgtttccacttgacataagctctataatcaaattttacactttctgatttctcaatgtcggagaaaagtgccttgggtatagcaagagctcaataaatatttgtcaaattaaattaaataaatgatatttaattaaatgggaaattagacgaagtacagaactttcaaatgactatatttaaatatttttcaagtgtgcaggttattaaaattatctagtacaaataaagcaggtgattaagagtacccatataatttctcaatcttgcttcagtattcagtgttattttttgagaagtgttcagatattgcttctcaatcataatcaagtttatatctctctatgaagaagtggtatctaattttatcttcatatcagagtcagctctaaagctttaataaatacactaatgcctaaaacgtaccccataccatttgaaacagtatttctggactttgaatcttggacactttgatttttttaattttcacaggtaacacaaatctataaccatgattaagaactatagctcagattattactccatatgaataagatgtaagatcaactatggaagatgcactaagctctcattttaataaacaggttatttatattttagagtatgccaactacttgtttctaaaagatcctaatatttcctaaaaggataaaataaggcactttatttttataccttttagttaaaaaaaaattcctttttctgaatactctgacttcaacatatccatagtcaagtaaagaacagatttgaagagattatgtaccttatttatgtaagcttatttttgatgtaatttactggtattctatttgtatttttggagaaattatgattttttgattgatgttatgattattttgcccttttctcttgaaatatcttagaggaaattctggctacattatgaataatgacatttctcccatatccctatcatgggaaggagatacaaggagatgttaacttgtgcttcttgttcaacatttttattacgtgtctttaaaaaatgatgaggtattctggaattcagcactatccacaagctaattataatcagctctatttctcatgaattctattcattcacttatttaattttattcattattttatttgatgaatatgtattgaataataatgatatactaagcactgtatttaaagctaacaaaatagacatgatcgcttcccttattgaacttagaaaatggcaggaattcatatggagagttttacacacacacacacacacacacacacacacacacacaaacacatacaacttataattaagatataaaagaaaagtaaatgatacggtgccttaatatacagggtaattttgagttatactagatgtcaggagtggaagggcaagtcaggttaggactcacagtagaagaatagacagctgagactgagagtttgaggaggaattagcaaggtgaagaaagggcaagggagtattctaggcgaagagaacagcatattcaagcatcctaaagcgggaaagggcttggaaaattttgtggaattgaaagaccattatgactggtgctaatgcctcgatctgcttctcagctgcttccagtataaatgtatgaatatggtccactacaaaaaatcatagcagacatgtattacatgcctactgtgtcccagacatagtttgaaacactatccatggatttattcgtttacttgtaataataaacttttgaagtagacactattagcaccattacttatttatagtattatatatatattttttcttttttttaggttagaaagctgatgtttatacagcctaagtattttactcatggccatacaactagaaggtggagtagttgtagggtttcaaccaatctgtttatccaacctgagcagctgatactataaaatgaaaattctagtggtcaaatatagaaaaggctaacacttatagtttatgatcaaaatagcatcttgattgataattatttacctaaagcaatgtttctcatccagaagtcccacatatgctagaactttgtgatgcccttagagatgtgcctccaaatatctaaacattttttctctacggagaacattatttaggctactcttgcgtgaatatgttgggtttctagtctctgcactcccctcatttagtacttagttttcttttactctctttaaactataatctcagattctcctgggcaatcaagacggtataggagctcacttcattttttctcttaagaattgcaatgtttacacatgtttttactccactttaataacatgacctagacccagtacattgtacgggtacagtacatagttgtattatgcagtaaatttacatagagagcattaaacatttattttatatatttttttatttttgaattaagatttatgatataaaattggagatttatggatcgtcaactacaggtctatgcctaaagctcagctctatttatgccctaattttattgtttgtgattttccatattgcctctttcatctttgaatttcaagttcggttgttgttaaaattctctgtttttttgtgtttatcgttattaatggaactagaactattatctttcaaattatattttcatttatgatgattttatttattgcatagaggttgttaaaatatgagttcctaattgtcaaaaataataacaaaaatacaatttttgagcaagtagtagagagattttaaagtataacgtgctaaaccttcagtttgtaacctggtcttgttgctgctgctgttagctatgggaagtatcaggggactaagtattattttatttatttgtttgtttatttctatgggttttcgggggaacaggtgatgtttgtttacatgagtaagttctgtttttttttttttgtttttttttttgatggagtctcgctctgtcgcccaggctgcagtgcagtagcatgatctctgctcactgcaacctccgcctcccatgttcaagtgattctcctgcctcagcctcctgagtagctgggattacaagcactgccaccatgcctggctaattttttgtatttttgtggagatggtgttgtatttttgtagagacggtgaccatgttggtcaggctggtcttgaactcctgacttgtggtgatcttccagcctcggcctcccgaagtgctgggattacaggtgtgagccaccatgcccggccatgagttaactctttagtggtgatttgtgagattttggtgcactcatcacccaagcagtatataccgtacccaattttgcagtcttttatccctcacacccctcttgccctttcccctaagttcccaaattccattgtatcattcttatgtctttgcatcttcatagcttagctcccatttatgagtgacaacatacagtgtttggttttctattcctgagttacttcacttagaataatggtctccaattattcaagttaatataggaaatgcctactttttcctctaaattcttagttttcgatagacatttttcactcctgtctgactatgttgagtgtttctcattgtgctatgcctgtataataattaatttttgtccatcaaaagattagtagcatttaaatgctactgcacatgttccttcttttgttgactagtaacactttagcatacaaatgactatgcatttggttactttttcagaaaagcatttattgtcaaggagattccttctccccagtggctcagtgaatttaacaaatgtacttgctcctgaaaacttagtcgtattttttattttcccagtactttgtggaaggtattacagtatccactttacttgcttaagcttgtaaagcttttgtgtcacagcccacagatacggaaggcttactgggaagcaaatttccaatgacaattgaaaagtacacagtacaaaagagagaagtgaccgaattatcccctaagtggttctgtagcttcttctataatatcaacaaaagcagtttttttctaaggcttcaaatctgccactgcaataagttttccctctgattctcgtctttccattgtggtagaaggactgtcaagcatgaagttcttagagagttgcatagcatttgggcttggaaacccagacactgcaacttcacaaagaagaaaaatattttccttctcagcaatctcagtcacatattaaaatgcgagataagagtgactcattcaaactaaagtcttctccaaccccattcctacaatcagcttgttcagacaaccacactttttctcaccatattttttcttctatttcagagattgtgctggtactacatttctctctttcattcttgctctgataactcagtgtgttttatttcaaatgtattttatttctcatattttcagagacttccacaaagctagtcaaatataaaactattgatggtggtagagaaagaagaaataaagaaagtcatgagttttgatgtaaaattaggtataattttgaaaatcctagggtcttaatttctaaagccttctaagtgccagaacctcattttttacttcatatacacattctttttcctttgtcctttattaaatctgacttaaattaactaccatgatgaagacttataagcagttttgcctttatgttattttttattccaaacattattgtccatactataaaattgacaattttataattgtcaatactaaaatggttgaagactattttattatgatcagtatattaagttttgtataaaagaatgaatagaaaaatctgaattttgaattcagctcagccactagcaaaatatgtgaaaatgaaatatttttgccttaacattctcatttttttaggaagatgttatcacaataggaccatatacacttgtacaatctgaattttagctacaaccttgaactgagattcaaatgtaaatttgcaattacttactggacatatatccacttagatatacagtatcatgctccacatgcatcaaacctccttctttgattcaggactcacaatgctgattttgcctatattttcaatctctatttatgattccagtacctttctattcaccccagccagaggtgtgttttcttagattcctcagtccctttaaaacccatactcacaattcaagtacctaaaggagaaagagtagattattctaagaaagttcaacagagaagtaatcaagaacattttgaacaaatgagatatgatttgttcatgggtactactgaatgggtgattatttttagagtctgctttgagaggcactgtacttataggaaagaggaaagagatggcaacattaaaaactaagtataaggtttcttgggaatgcattagatagggcaaaaatctattgaggaatgtggatgaagacgtaaaggttaaaagcctagaagcagggatgatagcactgccacagcgtgtgatggggatggtgggaaaggagatgatgaatgatactcaagtatgtatggagatgttggcaatgacttttgagcagtcaaatcttgattatttatgtaaggggataataaattagattcagagatgaaatgctgtttggagattagctaataggtacagtctcctttcccatcaaaccttttactggaaccacaatgaaatagtacatttgattgattcaaacttcagctttttctttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaataataagcatggtttattaaaaaacttattagggttattgctctataagcctggcatactatttgtttttgctttaaaacatagccccacattggattaaaaaaacaaaacaaaacaaaaaaaaaccaatatcagtctttctgctatcttcagaagaaccatttcacatgtaatgacacccatagactcaaaataaaaggatggagaaagatctgtcacacaggtggaaaacaaaaaaaggacagggattgctatttttgtattagataaaaagataaaatagacttcaaagcaacaatagtacaaaagtacaaagaatgacattacataatgataaagagttaaattcaacaagaagatttactactctaaatgcatatgtattcaatattggagctcccacgttcataaaaccttacttctagacccaagaaaagactttaacagctacacgatagtagtgaaggacttcaacacaccactgacagaattagagagacgattgaggcagaaaacaaagaaattctgcacttaaatttggcacttgaccaattggacctaataggcagctacagaatcttccatccaaaacccacagaatatacattcttctcatctgcacacataacatactctaagattgaccacaaacttcatcataaagcaagtctcaataagttttaaaaaactgaaatcacaccaagcatcttctcagagcacagtagaataaaaatagaaagcaacaccaagaggaactctcaaaaccacacaaatacatagaaactaaacaacctgctcttgaatgatttttgtgcaaacaatgaaattaagggagaaatttaaagaaatctttgaaatcggaaaatagacacacagtataccaaaacctctggaatgtgtgaaaagcagtgataagaagaaagtttatggtgctaaatgcctacatcaagaagatagaaagatctcaaattaacaacctaatctcaacctaaaggaactagaaaaacaagaacaaactaaatccagagctagcgtaaaaaagaaataactataatcagagcaaaactaaatggagacccagaaaacatataaaggatcgatgaaatgaaaagatgggtcttcgaaaggataacaacattgatatactgctagctagattaacaaagaatgaaaagagagaagatccaactaagcacaactgaacacaacatatgtgatattacaactgattccacagaaatacaaaagatcctgagactactatgaacatcactatggacacaaactagaaaatccagagaaactgaataaatatctagaaacacacaaccttccaagattgaaccaggacaaaacagaaatcctgaacagactaataatgagcaaaggaattgaatcattattgctgatcaacccaaaaagctgtggaccagatggactcacaactgaattctattatatgcacaaagaagagctggtgcagatcctactgagattattccaaaaatttgaggtggaaggactcttccctaactcattctataaagcagcataatcctgataccaaaatctggcaaagatacaacaaagaagaaaactataggccaatattcttgatgaacatagacacaaaaattctcaacaaaatgtaaccaaacaaaatccagcagcacatgaaaacattagttcaacatgatcaagtaggctttattcctggaatgcaaggatggttcaacatatgcaaataaataaatgtgattcaccacataaacagaattaagaaaaaaacatatggtcatctgaatagatgcagaaatgcattcaataaaatacaacatcatttcataataaaaatcctcaacaaaccaggcattgaagaaataagaactgtcaatgctaaacccacagccaacatcatactgactggggaaaggttggaagcatggcccttaagaactggaacaagacaaggatatccactctcaccagttctattcaacattttacttgaagttctagtcagagcattcaggcaacagaaagaaataaaaggcatccaaataggaaaagaggaagtaacattatttctcttcactgaatttatgattttatacctaaaaaaccctgaagattcctccaaggactcatagacctgataaatgacttcagcaaagtctcagaatacaaaattaacatacacaaatcagttgcatttttatacaccaatagcattcagactgagacccaaatcaagaatgcaatcccatttacaatagccataaaaatataaagaacctaggaatacacctaattaaaaaatgcgaaatgtctttatgaggagcactaaagacaaaacaacaacaacagcaacaacaaaatcacgctgaaagatgacacaaataaatggaaaagcattccatgctcatttcatgctcatgagttggatgaatcaatatcattatattgtccatactgcccaaagcaatctatagattccacactaatcctgtcaaattaccaatgtcatttttcatagaatttgaaaaagaaactattctaaaattcatattgaaacaaaaaagaggctgaatatctacggcaactctatacaaaaagagaaaagccagaggcatcacactacctgacttcaaataatactacaaggctacagtaaccaaaacagcatgggattggtataaatatagacacataaaccaatgtaacagaatagaaaactcagaaataaggctacactcctacaaccaactgatctttgacaaaatcgacaaaaacaaataatggaaaaggatatcttattcaatgaatggttctgggaaactggctaaccatatgcacaagaatgaaactggaccactacttttcactctatacaaaaagtaactgaagatatatcaaggaaattaaatctaaggcctcaaactgtaaaaatcctggaagaaaaccaaggaaatatttttctagacattggccaaaaatttatgactaagtcctcaaaagcaactgcagcaaaaccaaaaattgacaagtgtgacctacttaaagaagttctacatgcaaaaaaatatttgcaaactatgcatccaacaaaagattaatatccagaatctaaaaggaacttaaaaagaaaaggaaatatccccattaaaaagtgggcaaagaatatgaactggcacttctcaaaagaagacatacaagaagccaacaagcatatgaacaaatgctcagcattactaatcatcagagaaatgcaaatcaaaaccacagtgagatgccatctcacaccagtcagaatggctattattaaaaaagtaaaaaaaaaaacccacagatgctggtgaggtgggggaaaaaaggtaatgcttacattgttggtgggaatgctaattagttcagcccctgtagaaagcaatttggagatttctcaaagaattaaaaatagaattgccatgtgactcagcaatctaacacagaaacagaaaaccaaatactgtatgttctcacttataagtgggagctaaacattggtacacatggaaacaagatgggaacaatagatactggaaattccaaagagggagggagaaaaagagaaagaaagaaaggcttgaaaacatcctattggataccacattcttggttgacagggtcatgagaagcccaaacttcagcatcacttagcatatccatgtaacaaacctgcacatgtaacccctgaatctaaaataaaaaataatttaaaaataaaacacaaactctagattatgatagttattccttttatatgtagaaagttcatttgaaagtgattttttaatagtatcgagatatcaaaataggattttttttccagacaataaaacatatatgagcccatgtggagataattatcatcagtagtttttgattttcacaaaccagtcatctccagtgttgccttttcttgaaaacattgagttgtactgatggtagcttcgaggcttcttttcttgttcttcctggtattctcacttctaattttgataacctgtggtgcaccatggcttctgacatgaacactaattagggatggcagaattcaggcttgaagagccacagtgaataggaggaaattgaaagatggactcagacaatgacaagaaggttcttagctctacagaagtaagagtacatttgttggaatgacagatactgaaaaagaaataaaataatactgtcctgtcagtggaataatatcaatcaactgttattattatttatagttacctattattgttcttgttggtcatttcttgtgactgtgaattagaacttagtttttggcatgtccaattcaatttctgtgtattttttcctgtagcatttacgggagtatgagttattgatatgcaatgaaaatactagtagttaaggttattgtcaactaatattcttaaatatatgacccctttccaattttgagatcacagttttgctatgtacatttataaaacttaaaaaatttaactgagaacaaaataactgaagactattttagaatgcctaaaatatagtttagattagtggtggtatttattaaaataatttaaatcacaagcttggtatcatctgtaggctctggaaataaaagaagttatcagtctttataaatgttaatgatactagattcccattaaatctcatcaggttaaaaatacagttttaatgaatgaaaataaatgcagtataaaggaatcatttacaaataatgtaataatctttacttctgcatttctttttatataatttctgaaacttttctaaatgatcagctaaattagcacttaaatatattttgttttctaatcttgataaatttgaaactcttttaaaaattgttttacagttataagactcacaattttagtcacgctcattaacaaataattggctatctaagaaaaaaaccccaaaactcttttatttctcaccataataataaataattttatgaaatgttcttaaatagtaaaaaagaaacattttctgaagcaatttaggataaatgtaagaacaatcatttccaaccaataatcacaaattattaaaagttaggccataagaatattagctcttcattctgcttgacagtatttgagcatggcttggcttcttacttggcaggtggcctggcactcctatgccagctgtcaagctgaagacgtggctggacagatactttagaagagctacgtatgatgttctgagtgagatctaaagaaaaacagaaactgaagaaacaaaacataaagtttgcctgcattaagagcctgtttttctgtaatatacatttcatttttttaaaatcttgaacccactctttcaatacaggtgcccattattataaattctggttttggctttagagttcaaataattcaaattatctgcaaatctgtaatcaaagaactgtctagatgtccataatgaaagctatcctcattactactgtgaaatatttgcttcatctcaactttccgatgaaattctcatgaaaattcagaagaaacaacacaaatacaattttaaaagtgatattttaaaataacgttaaaggagaactatcacaatttcaatagaatacacaaatagactttattgggatagatttctgtggttgaatgtttttaatgctataaatatagaaaaatatcttatttttgaatttttttcttatcttgagtcaatttatggaaatgctcctgtatttaagagatttacaattaattgttcattaattatatgccctttggtgagaactttactcttcatgcctgatcttgtttttcgttgttgttgtttgtttgttttgttttgttttgagacggagtcttgctctgtcgcccaggctggagtgcagtggcatgatctcagctcactgcaaccttcgcctcccaggttcaagcaattccctgcctcatcttcctaaggagctggaattacaggtgcctaccaccatgcccggctaatttttttttgtatttgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggcaaaaatacttatattccagcaataagctattattggtaatggttaaaaaatattctcatgaactgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattttatattgtgcactgatatataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttctgctatttgggtttttttggagcgtctatttcccagcctcttatgatttaagtactccatttatttatgttgattttaatcacttagtggtaagttcatatgaggctgaacttttctttcacaagtcttttgaagatatttataaattaaaagttgtatagctagtgattaccagagtgctttgaaatcaagcagaacactcatcgcttaaatcaaaccagactttggatttcagataacagttatttaataattcatttaaataatacactttaaaaaactacttttaacatctacacatttctttttatttagggaaatttagacaattttgtttattaaagctagtgttcatggtttttttaaatatcaccttccagggcagacatggtggttgggatgacttgacacctgaagttcaagagcagccagggcaacataggaagaccctattactacaaataataaaataaaaaaaaatagccaggaattttgacatgcacctgtggtcccagctactggagaggctgaagtgggagtactacctgagcttgggagatcaaggctagtgagccatgatcttatcactgcactccagcctgggtgacatagtgagaccctgtctctaaataaataaaaacttacatacatacataaagtcaacttccacattttttgtcccttaacttgactagtgccaataagtatctttaaatgaagtgtgtatgtttactaattttcattccattcatttattgcctggtgaagtgactgaaacattaaattttttcaattttcacatttcctcttgaaagcaattttgatatttttttcattggtttaactttggttttattctggctagccagttttattttaacttgtttaaagcttacaagactattctccactttatgtttgtaatttgtttttatacgttgatttttgtcaggctgggtttaagtaagggtgatttaaatttatttgacagttttctatgaaaatgtcattccttcatcctccaaaattcttaccaatctgaaaaaactacccattataaaaagaggtacagattacctatgagttccttttttttttttttttttttttttgagacaaaatctcactctgtcgcccaggcaggattgtagtggcatgacctcggctcactgcaacttccatcccccgggttcaagtgattctcatgcctcagccccccgagcagctaggattgcaggcacccgccaccacgcctggctaatttttgtattttagtagagatggggtttcaccatgtttgccaggctcaaactcctgatctcaggtgatccacccgcctcggcctcccaaagtgctgggattacagccgtgaaccatggcgcccagcctatgagtttcttttatgtctttggaagcataccctgaagttatatgttttcctgctgcaacatggctttgttttcctctagcctctgaagtagctaggactttttttcaccatactcctgggaattttctttaccgatcttctgtgctacagccccatttcctggatcttattcttgcatttttcttgaattattttctcattttgttaaaggctgtaatagcatcctgagaaaggttgctgagtacaaatttaagaccttatatgcccaaaaacattgagtcttccatgaagaattataggttgaatttttggggaggcattactccattgcctttttctgctgttgcagttgttcacaggtcattctgattcttaaccttttgtatgtggcctgtatttttccttcctatgaacaatttcaagattgtctctatttctgaagcttggaaacttcactaatgatatactcttgtgtatagaattaaaaatgaattttaaaaatttaaaaacttcattatgttgaacattctctagagtcttgatttgtgccgtccaatacggtagcttcgtcacatatgactattaaacacttgacacctggcttgattgaatggagatgactgttagtgtgaaataaatactggctttcaaagacatgatatttaaaaacgtaaaatatcttaaatttatattgattacatgttgaaatgatagtgataatattttgatatattaggttaaagaaaataactgatgaaattgaattcatctttaactttttaaaaatatggttattagcagaagctacattatatgtgtgctcctttttggggcttgttgctatatatatagttatatatatatatatatgtatgtgtatatatatatatatatattttttttttttttttttttttgagacagagtctcactctgtcacccaggctggagtgcagtggtgtgatcttggctcactgcaacctctgcctccagggtttaagtgattcttctgcctcagcctcccgagtagctgggactacaaatgcacgccaccacgcctggctaatttttgtatttttagtagagatggggtttcaccatattggccaggctggtcttgaactcctgaccctttgatctgccctcctcggcctcccaaagtgccaggattacaggtgtgagccaccatgcctggcctgttgcattatatttctattcagcagcactggtccagaatcttgttgggcatattcaatccagaaactcagttccttcagtcttgagatattttcttaacattagttaacatggtaatttcctttccatcatttctcattgtctgtatcactgagtattggtcatctgacggttagacttccaagtaccatgtaaacaatagatagattctgtttgttttaaacattgatgtccaggtctcacatccagacattcaggttgatgaaacccagacagtattgtctgaaatctccctacatgattctactgattgtctaacttgcagtcgtgtgatgagtaagttctggagatctaagctacaacatgatgagtattgctaatgatagtatattgcaaatttgaaacctgttgagagattagatcttaactattcttaccacacacactaagaggttaactgtgaggtgatggatatgttagtcaactttgattgtgttaatcatttcataatgtatatatataccaaacattgtttcataagccctaaatatatgcagtttttatctctgaattatacctcaataaagctggaaaaaaagaaaaagggaaaatagtctggggaattaattttaggctgatgcacatttttatttagtcttctagatttcaacatagtgcttaatctctgcgaatctagagccacttcaattcaattacttcttcagttttctgccagggtcaggacaaaaagaatgggtagttctccagaaatgggttgaaatttctacctaatttactacttggtacagattatggacctctgaacacggacttttgttggggagaagaatgaaatatttcttgtactgtctctggttaatcaaggattattggtttcctggggccttatatttagtgtcaattcttcaaaaatgataggtaaagttctttatggggttcaggacatgctacccccaaatgtgtctccgtggtattaagaaagtctaggaaggtcactttcttttccccttctcccccaaagcacgtcataagactctcatctgagaggtaccctccctacacttggaagaaaagaacatccttatctctgaaatcacagggacacagagaagaatatgaacaaacagttcttgctaagtttccctcagtttattactgttagatcctacccttttgttctcaaatcctatttccccttaactgtccattcttcatcaaacttaagcataaaagtacataagtttacttcattttggagagtcttcatttctgaaggtttccatgtcatgtaaaacttgtattaaataaatttgtatgttttgctcttgttaatctgtattttgttatagaggccacagccattaatctagtgatgggtgaaaaaagaaatcaacccaccaagattccttaatcaattgcctgtaactctatatattttcaatgtgtaacaaaaaggtcatggattccagccacatgtgtaagccaagttgaccaccctgctgtgccagtggaaacacactgtcacagtaagactgtggtattacctacgtatcaataagaccacagacggaattttgtatctgcaatttttccatttcaagagttcatttattttaaacataattcattaccaacagctaaccctctttttttcactctattaatacaacttttttttttttttgagacggagacttgctcttgttgcccaggctggagtgcaatggtgcgatctcggctcactgcaacctctgcctcctgggttccagcaattctcgtgcctcagcctcccaagtagctgggattacagctgcccaccaccacgcctggctaattttttgtatttttagtagagacgaggtttcaccattttggccaggctggtctcaaactcttgacctcaggtgaaccacctacgttggccttctgaagtgctgggattacaggcttgagccactgtgcccagaaatacagcttatttcttaaaaatagtctggaatatgcttttttttttaattgaatgaggctctttttgatgccaggttcatgctcctgcaccagttttgtttgtttgtttgtttgtttttacaagaatgcctacaacttaccagttaccttcaaacacaattttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaagatatttcagatagtggggaaaagtatatttgaaggcacagatgtgtgaaagagtttaggatatatgaataactctaagtagtctaccactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcactggacaagatttggtgagaacagccaaaaaatattgcaagaatacaagctgataagatctgaattatggaagactctaaagggatgagggaaagaaatcagatttgtaagatatatgggggaaaaatgaagaatatatcatttgcaaattggactttatgaagtcagaatttaggaagacatctttctgataaatatgactggaaatgggattgaggtaaaaaagcagaattgaaataatacaggatgaatttaattttgaacatattgcattttattttcttgtaatatattgatctagttggcagttagatatgtaattccagagctcaagagaatgttctggcttggagataacttttggagttaagatgatggttggtctcatgaataatggtgtgatagttcactcagggagcacatacgtgtttcagtacatttacactattggacatttctttcttctcctgacactatttcagtgattctgtcctaaaacttactgtattctgtttggtttgacaaacaattataaattatgggcttccaaagaaggtaaaaagcatctgggattaaaagaataaaatgtcctttgagtctggctcacaagttctttaagcatattgggaaatgatgattgtaagatgacagccatgagacattcaaaaccagtaaatcctgaatatgtcagatacctgcaacctaacttcatttcctgatacttatcggattcccaggtcctgatctctgtgttttcaactacaacttgagtacttgacattgatttctaattacttctcttcatttgagatttattggatactcttaatgacagactatatcctgactccaattaaccccactacagtgactcaaaaagaaagttacagacttcttcctctcatagaaaacacacatattttgtcttgctggcatcactggaatcagtgctttaacataaaaatccacaataacagatgagtccttggtttatccatttatcagtcaattattttattaggcatatttcttattaggtgtttatatatagtgacattaattaggtgcctaacctggaatgaatattcttaacttgaatcctataaattttatattctgagctctcttagctttagttctacatagtaattgattaaaaaaacaaacaaacaaaaagcatgaatttattttaactactttgagtaatctcatattggaaaagcaaacaaaacattttttcactacttcatcagaggattaataaaagaaagaaatgctttcgccatatagttgtttgaaaaacatttcatgttatatgaagaataccttatgctacattcaaatataattatagccaaaggcactaaaatatttattttcatgtatgtcacagctttatgtctttaaaaactcaaaatttgtatttgctgtttttaacttttaaatttacattgttggcaagtatgatactccctgaccttgaagagaaacaaaacagtaccttcaaagtgaagcacacactttttgtgccctcgagcaatagcattccgtgtttactatttgtttacatcagaatttcagtgtgctccacagttctgataggtataaatatataggcacaccctaaaactatcctgtacttaaatagattttagaggatactgggttaagcagcaaagtttgttaggttttgttatcactgaatgtttaacaaattcacgtgcattgtgaatatctcagaatgattttttttttttggtacggtttctctctctgttgcccaggctagagtgcagtggagcaatctcagcccactgcaaactctgccccccaggttcaagctactctcttgcctcagcctcccgagtagctgggattacaggcacccaccaccatgcccggctaagttttgtatttttagtagagatgggggtttgccatgttggccaggctggtctcgaactcctgacctcgagtgatccacctgcctgagcctcccaaagtgctgggattacaagcgtgagccaccccgcccagcctgcagaaagattttttgaaactaaaacttggggcataatttctcagaagaatacactgtggaaaacaataagttagactctgacgattttgaagcccttacaaatatttataatggaattcacttatacgtgcaaatctatgaactacataccctaccaataattagcagaagagcagaccatttctataattagttgacacttggtacctggatttaatatctaactgaaaagaagctttcagtaaggtctgcgagttgaatggaaaaatggaagtcagaatctggttttgaatcgtgagcctgccacttagtagttgatttactttaggtaagttgccataactggagtggggataataataatgaataacttgaagtttgtttctattagagataaaaatttataaattatataacatcattcctggcacaaaattgtcagtgagtgatcgtttttaacgaccacagggtaatctaaaattaaaacataataaatggtgttcttcgttgctatttccccccggactttctaatatgttttttaacattttctccttatgggccaccattcctcttcttcaggccatgtgttggtgaacttcttctctatatcctctctcaattcatttctcttgcttggaaattcatttatctccatttacctaattcatactcattctactcatacctttttctggtggtttttcctctgggatgatttaactgactgacttgggacatttttacttttcccttctctcacatctaatgatccttttttctataaaatgttatctttatgcatttaaatgcaaacttttagtattagtttatatttttctgtacaagttctctgtcctcaactagattaaaaggtgcttgagagaagcaactctgtcttaaagcagagtattttctttaaaatgataggtattcaaaaaacttttttttattttattgattacaaaaggcagcagctgaaagttaaactcactattcattatagaaaaagaactttcagtagacagatgtggctaactactactgatcattgaggaataattctcattgcacaagatctttttcatgtctgttttacatgcatattcagtgacattgaaggagttttccagtgtctgatcaacttttgagtgggatgtgggtagaaagcaagttagtattgagttctttattctaattcatttctctatcaatgtgtttccatttgttttggagaaacaaacagaagtagaggatggcaaacactggaatctcctttctaacaccagagggcctccaaacaaaatgttcagtgaattaaaagaaatagaattctagtcattgaaaactccaccttctaatctttggatgcaaaatgtcttcatttttcgattggctccatctttctttcatacattcaaatttattcgatctttaagtagtgaaaaatacataaagagaatattgaagaaaaaaaattcaacctcatttattacaccaaaattggttttaggtagatgctttaaaacaattttaggaaatggaatgccattctaagcaggatatgaattcaaagagtggtaatcagcaataattatatctggatagtttgtcagagtttgtgggggtaaagatttttcctaacttaggccttcatgtccttgtatccccctgtctttcttgctccacacttttcttcacttaagtcctacagaactatttatactttccatcatccacatgagtcattttccctcttcaaagtatttccatctacgccacttctttaactccatagttatctgtcttgactgcatatttgaccagctaaataatttctatcccatgtgcaaaatgaaaatgagggatctcttgttgaacaagtactaagaatttcaaaaggacactagcagagcagaaaacccaaaagcagagtcctttgaaacgttgggccctgtaccacagcacaggtcacgtccccatgaatctggcccaactgcacgttataatcacataggaagttgttttttgctttgtttcatttttaaataatgatgctaaggtagtgctcagatgcattagatcagaatttctgggggtaaggcccagacctcagttttgtaattttaattgcattttaattgtaaaaaatttaagtttattttaattttaatgtgtagccaaggctgggcaccaaattcaaaggctatttccttgtgacttggcatatacttacctatttacttttctatctctctcatgagaccattgagttccttaagagtagatatcatatctttttagccttttcatctttatgacatagaacaacacctggaacattttagatatctattaaatagattatactgaatgaatgattaaatagatactaatatgacctcatttttaattttacagggtgtaatcaagaaaaaaagaaagtaaaggcagacttattggatgataatttgaaagtgtaaagagaaaacatactcttagaaaaaatgtaataaaatatttgagaaattagatctaaatttactttttaaatgaagggtattgagagatacaatagtcccctcaattctgtgcttaaggggaaaattatcttatttacactattactcattaaactttcagagttgaggaaaagcaagaataaggaaaaaagatgggagaatgtttacagaattaaggaaatatgatgtttctcaatatgtgtgtaatacagttgaataataggagaataaatttgtggtagaagattccttctcaaagaacgacatggcttgtgaatggtactagaactggaaaataatgagccattattagcactagttttgtctgatcaaattaatagaataaatgtaattgctcataagcactagtaaagaacaatcttaagcatttgctagttttaaataatttggtccagattttaacatagcatacattttccattatatgattgtgctagatgtttacacataatgtaagagtatggcacatataaatagcccattattatgttgtgtttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgcccagccttgcatttgtttttacccatgaggccctggcaatagcctatctgctttctctttctatggtttgcgtactctggatatttctgggtgactagaatcatgtactgtgtggctttttgtgtctgcctgctttcacttagcataatattttcaaggttcatccatgctgtaacatgtatcaatacttcaatacttttatgattaaatgatattccattttatgcatattcatcatttagtttatctgtgaaaccactgattggcattcagtttatctccaaaatttggctattgtgaaaagttctgctatgcacattggttcacagtttttgtttaaacaccaatttttaatctttttgggtatatacctaagaatagcattgctgagttttatggtaattccatatttaactttttgaggagctgccaatattttttttatagcagctgcacaatttcactttctcactagcaaatgtatgaaggttctattttctctatatcctcaccaacttgttactttcatttttaaaattataaaacatcctggtaggtgtgaagtggtatcttactgcggtttagatttgcatttccctaatgactaatgatgttgagcatgtttctgtgtgcttgttgacatctatatgtcttctttggagaaatatctattcaagctctgtgcccatttttaaacagcattgttttttttttgttgttgttgttgtaggagttctttatatattctgaatagtagaatattatcagttatatgattcacaatattttctcccattctttagtttgtcttttcatttgtttgacaatgtcctttcatacacaaaagttttcacttatgataatgtccaatttatctatatattttttgttgattgtatttttggtgtcatatcaaaaaatccattgccaaatccaaaatcatgaagtcttacctatatattttattgtgagagttttatagttttatcttttacatttagatcatgataactttggattaattttttgtgtactatgtgaggtaagtatcaacttcattcatttacatgtagatttttagttgtcccaatgccctttgttcaagagatgattctcattattttgttgagaagttttacatctgtattcttaagggacattggtatgtagttttcttttattgtgaagtcttttctggtttagtatcagggtagtgttggcctgaaagaatggacaagaaggtgttccctcctgttttattatttggaagagtttgagaaggattggtgttgaattttctttaaatgatgatggaattcatcagtgaagttatttggttctgggattttctttggaggttctggatgactggttcaatctctttattttctctagatatattcagatttttatttctatttgaggaagttttgatagcagtgtctctgtagaaatttgtctatttcattggggtagtctaatttttgatgtgtaattatttctatgattctcttgtaaactttttatatctacaaaattggtagcaaaggccctcttttttcatctgattttttttgctattacttttttcttgattggtctagctaaagatttgttaattttgttcatcttttcaaataatcaaattttggttccattgcttctctctattttttttttctgttctctcttttattatctctgaggtaatctttcttcttttcttcctacctgcaggtttagtttgatcttattcttctaggtttctatggtgtaaatttatgttacttatttgagatttttcttcctttttaatgtagatatatacagctgtaaattccctttgagggactgctttcactgtatccattgagttttaatatgttctgcttttgttttcattcatcacagagcattttctaatttcccttctaatttcctctgcaactcattggtttctctcaaggccagtttctattaatttctttgttcctgtcaatgggctgtactttcttgtttgtatttttcacttttttttggttaaaaaatgggcattttaaacagtataatattgcaactctagaaataagatattcccctcacccagggttttttgtttactggttattgtagttctttgttgtttagtgaccttgctaaattaattttgtaaagtctgtattttttgttctgggtggccactgaaatgtgtgattgttaggttagtagtaccttagtaacttgacagagatttccttaaactcctggaacaaaacaacaagaaacaaaaccaaacttcccgtctttgtagtttggttgtatattggggcactcctttactgtttagccaggcagtttacaattctgccctattcttccttcctgcttgcatggagcctgaatctagccagaggtaagggcttagggtcttgtcaggtcctttctgagcatacatcccccactggttatgtgcatggactgctagattcccttgactatacgggagcttgtcccagctcttagtgcccccaagtatttcctccctagtctttctgtctcaggctttcaggtcaatctatttcttgcccctacttttccctcttacccaccaggtggcaggtaatatatttgcctttaaatgcttacaaaaaacaccacgtgtgaagcagcttcagccttagggaagctccttatgcagatgaaccaatggcaagtccttgagcccatccctctgggagccaccacacaggttaaaatacgtaacaattctgtaagaataaggtccatatggtttcctatggtgtgtatgacctgcatcaggaatgcaggctactatcttcaagactgttgtggagctgaggagtatcaaatagtatcaacagggtaaattaatatgccacagagctctccaaccaagattctgtagtttttcccttcactaaacatttccttgtcgttgtaagtttttattcaattctagagttatttaaaaattgattctgatggtttgccagtttatcaactgcttctatggctgctttcacactataatgacagaattgaatagttgtgactatatagttcataaagccaaaaatatttactatttggtctttaaaggaaaaaatttgaacctctagtctacatatctatattcagaatttacataaaaacatttgtttcatgaatgtattaatgactaaattggtggatgaatggatgaatgaatacatccaaaatatttatattttaacacgaggtattccaatatagatatctacatgcatcttgttaaacttcaaataaaaatttagaaaatcatggtaatttattgatcatctttggagttgctcttttcacttagaggttactatggaaatacaggagtggcggtagtcaattatcaataaacatgccaatcaaacacatatattactactggggatcattctcatggtgtttataagctgtcccccatcccttgatcaaatcatactgtatgtgtgctaaatctacccaagagtgttgcttattagagtaatgagttgataacatttttgtgagagaaaaatttatctttgctgaaaatcttcctttattctgcttgtatttctttgtaagcattagttatatttcttgggtgtttttcatcatttgagaagaataccttttacccataataaaagtaaacctatccatgaaaattttatctaataaaaatttttagtttagatgcctgaaatcaaataaaaataatattaaacagggttgaaaagaatgttaaaacaggtaactaaaacttgctgccttatactatctagtaaagcagactttccgaatgtttatcctctgtgcttggatgagaggactgcaagtgaagatttgggaaaattcaagtaaagcatggtctaggtagaaagggaaacaaagaaaaacccccaaaccaaaactaacccaacgaaaaagggcagagggttatcctttgttccatctccttaacattgctgtccatagtaatacctttcatccttaatctcccttttaaaagtgtgactgtcccctctgcattatcctgagcacctcttgagcccttagggggaaatatgttgaggtctgtttcattttattgttgttaaggtgtaagtctgatagttataatgaaccaactcaccttcctgaaaagcataattgttccactatttctgttgcccattcatcagccttctactttcaatcaacttaacatctgccttgatttccatactctataaaaactagattgccctcttactagttatgatttaatgccttcagtaagagggcagtaataagatatagagactgaacacactgctcagaaaatagaaggaaataaattattttcaggaaaatatgaactgctcagttttgtttcaattgccgtaatattactttaatcttagattatttttttgtaaccattatgtctttttcatttggcccatagggatgctatttaaaaaaaggagggttttttttttttttttttttttttttggtcaaccctatgttcattaaggaaaaaaaaaggcaccattaggtaatattttctaaatgcattgatatctttaagaaactggaatttcagctgttgccacaaataaactttacaagttttttagtcataaggataaattcaagaacaagactggggttacctgaatatacctgtctatttttcaaaataaatgatttgtgggctacagcatcctgtgttctgagattcaccacaatgctctaaaacaagacacatgtccctgtttctcaaaaacgtagcctgtgagaacattctgcattccacttctgataactaatgaagcaaagtagacgtgtaaataaatacaggataatatataattggtagggatttcaaattcaccactagattgggagtttcataagggcaggaatttttctatgttgttttgatttgtttttcattgttcagtgttgtatacctagcacctggaagagtgttgggacagagtaagagttcagtgtatgcttgggtaaatacattggtttatttattcttatcattgtaatagcaggggatattttatacatatcacattaaaattaatttacattttaatgtccctatgttttaagtagcatgagtaagacactgatatctcagggttaacatatgaaaaagataattgagccctagataagagctgagagatacatgagttatatgctttaaacattattaaaagttttattatatttaaataaaacatttttataccctcaaccttaaaatgtattttactttttcagaacttcattttggattcattctgtgccaactcccagtctaatgcagataaaaatatatgagttattgggttccttaaaactggggttgatagtagaaatgctgacaaatccttattacagatgccagtggaatgaagtgcctttacctctagcaaatgctgatgtggagatttaagactatatgagaaatcagttaagttgcccaggagagttttatcatattattcaatgaacttggtatgtgatgcagtaattgcttttggtaccatttttcttctcttacgtgaggttattatttatccttgtaccgtgtgaaacagagaaagagagcttaaaggagagtcataacttgatgtaaaactatcccatgacacagtgtagctggagataggaatcaaagcaagaaaactgcatcttacttatcagaattaaatatgggaagagtaatatttgacattgtggagatccataaatactaaaaagatgcactcagaccacaaatatttttttctagtgatgtgcaaacctgttgaagacatatatctaagtaggttttttaatctcagagggatcaacaaatttatttgcctatgacagaagttttcttattagctttaggtgaaggaaatcaaattaacaggtaggaggctagtaggacaagttagagtaataagatttaaatagcctaataacttttacaattatattgctgttttcacttattgcacacatatatccctcatatgcttcacagactcctaacaccaactttgattatattttatccagtgttcaagtcagtttctgtgaaaaataaataaaaagtacttaggaatataatttaatttaaaatagagacaattataatttaacaatgcaaacagaagaaaaagcatttttagatagtcatatgttgctacctaaatctgattagtttaatagatgttatttttataaattcttaaaatactttatgttaaaaaggtgtgcttttatttagaaatgagatgatttgtcaggtagaaaatgaattttgtgtattttatatttactatttattttcttccataaagttgtcttgatggcattgttcaataattaataccattttgcatacaatatagcccagtggctaatcccagttaactaaaaaaaaaaaaagtcatacaacaggtgtttaattatgtaatgaactatttacaattttatattcacatggagtttggaaatggtcagtaagaattatttaatcaaggaagtatgggagggatgggtaagtggtccagcagtcagcctggctgagttgtatactggctgttgactatgggcaaaaaaaaaaaaaaaaaatcttaacaccctttccctcagttttttcataatagatataatattactgacctcatgtagttgttatggagaatacaattgaaataatccaagtaaagcatttagaacagggtttggcacatagtaagtgcttgggaaatgttaaacattactattgcttagtcatggggattggcaaattgtcgatctttgttccttttaagtaaaacaaaacaaaacaaaacaaactctgtatttgaaaatcataacctaaatgaaacaaaagtatgaaatcaatagagctaatttactatacctacatgctttatttttttcccattccaccaaccctgtattctcagtctttcccctactctgcaagggaatatgatattctcctcaagtccttaaccctctacacatgggttagtgacttgaggatttgttaccatcatgcccgagcctcatagtggaacttacctgtctcaatttttttccttcaagttcaggtttccctggcttccccggttgaccagaacaattcgtttctattcaattcatttcagcagtcattttattggtaagcctgctatgagccaggggatgtttggtgcttttgaagcaaaattaagtaaccattttgccgagtaaatcgctcaagtctagttcagaaggcttacatataaatcatcacctactacttggtatgataaatgctatggtaaaagtattcaaaagttgttgcaggagcaccagaaaaagaaacacctaaatatgtctgaaaagtgaatactcagtaccagaaagctgtttcaccacagggcttcttccctttctaatataacaagggcatataaactatgatctatggaaatgtgttatctacttgaaagactagcaggccaggaagagtagtgaggcaaaagggtatgataacctcttgggtggaagggcactacatctgttacatttgcagtactttgtgtacccctggggaataaagtttatatgtgatcaaatgttacataaaaatcagacaagatcctaactgttcttttacttatgttaagctcaaatatgtagctttggatgtagttaacagattaatttctgattcccatctgattcaatttaaaaatccaacatatacggttttctcccagacgatattacgatgtagaaagcaacctaaaatagtgggaaaagtaggtattgtggaagttgaaaaacctaggttcaaacctcttattttgttgcctcttttagttgttctttacctcttcttagctatgtgacctgggaaaattatttaacctctttgaaaatttaaatgtcaaatgaaaatagtcccaataagactgcattgaaacatatgaaaaaatgcttaacatcatatggcattagggaattacaaattaaaacaacaatgagacatcaccgtataccctcaagaatggccaaaatccagaacactgacaacaccaaatgctaggaagaatgtggagcaacaaagcctctcatttcttattggtgggaatagaaaacagggctgccactttagaagacagtttggcagtttctttcaaaactaagcatactcttaccatatgatcttgcagtcatccaccttgatatttacccaaataaaccaaaaacttatgtccacacaaaaaccagcacatggatgtttatagcaactttatttataattgcccagacttggaagccaccaaaattttctccagtgggtgagtggacaaataaactgtggtatattcacactatgtaatattattcagcagaaaacagaaatgagctatcaagccatgaaaatacatggaggaaacttaaatgcttattaccaagtgaaagaaaacaatctgaaaaggccacattccaactatgtgacattctggaaaaggcgaaactctggagctactaaaaagattaacggttgccaggagttagagtggggaaaggaatgaatatgtaaaagcacagagaatatttagggcattgaaactattttgtattgatactacaatggtggatgcatgccattatacatttgtcaaaactcataaaatagacaacaccaagaatgtgcccataaggtaaactatggactgggagtggtaatgatgtgccagtgaatgttcgtctgttgtgaacatgtactgatttggtgctggatgttgatagtagggtaaactaggcctctaggaggggtagggagatatgtgaaatgtctgtaccttctgctcagttttgctgtgaacctaaaattgctagaaaaattaagtctattaattaattaattaatttgagacagtcttgttctgttgcctaggctggagtgcaatggcacaatctcggctcactgcaacctccacctcccaggttcaagagcttcttctgcctcagtgtcccaagtagctgggactacaggcacctgccaccacacccggctaagttttatatttttagtagagatggagtttcaccatgttggccaggctggtctcaaacttctgacctcatgtgattcacccacctcgacctcccaaactgttgtgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgttaaatatatttagaaattagaaaattgagttatagaagtaactaatttatcaataatttatccaatcagtatttactgggcacctactatatgctaggcattgtattaggcatggaagatattataatgagttcatataaatgttatattttaggagagtgagacaaaaacccaatagtaagccaacaagtaaaacaattgaaaatgacttaagtactgtgagaaaataaataatgagatagataataacagagaagattctctttagatagaaccaaaggaaagattttatatttaacttgagccttaaaggaagcaaaagagctcaccatttgaagagcattatagacagataaaacaacaggtaaagggctttgagatggaaaatagctttgtatttttgaatctgggagaaaacaggatatctagaccttaaggaaaagaaaatagagttggagagagaaaggtaagttttaagcctttatgatgaatattttattcatttaacacatgtgccttgagcaccaacggcttgccagtcattttcttctatgcactgagataaattaatgaacataatctctaattcctctatactcatgggtttatgtcataataggggaagaaagaattgcacatacatcaaaagataaataaacaaaacttcagatgggatgagtgctatgagcaaaacaaagcagggtagaataatggagagtaccttagaggaaagaggtaacatatatatgcggtttctttgaagtggtgaatcttgagcatagggttaaatgacgagaaaacaaccatgtgaagatcttaagatagatcttccctgtcagaaaaatcaatcaatcaatcaatcaataaaaaggcagtgcaaagagccaagacgtggagttagaaacaaatctggcaagtttgaagaccaaaatgaaggccaatgcctggaataaaatgagaaagagagggaatagaagctaagttcaaagagaataggccttgaagaccagcataaacagtttttattttattccagttttaatgaaaagccactgttgggttttaagcaaatgcacaataaaagcagatttagtttttacaagattgctacgactttctggggagaatggactgagggggggcagaaatggaaagtaaaagatgtagttacaataggaattcagataagaaataaaggctacatgagccatgattctagcaggggacagtgtaaagaaattagtagaatcagtatatattttgaggggagaatttgcaggatttacaaaggataaaacagaatttgagaatgattgcctggctttggacttaatcagttttgtgagttgtgaagcctttcaccaagatgagagcaagtggtagaacaacaggttttagggcccatggcaatgatgttgaatgttattctaaacacattgggaatctatgtgatgatttcaagtagtagtggggaggtaattcaatgtatccttcagtaagatcccttgtgtttctctgtatcaaatgagctaaaagaaagggaagcaaagatgatgactcacaaatcagtttgagtagcagagtaaacgatggtgccattttctaaaagcagagaaaactgaaaacatgtaaaagttttggggaaaacaagaattatatttgggacatgttaaatgtgagctgtaatataatgtctatgagacataaaatcatgctgacaagtgctattggatacgtgtgcctaagacttgcaagaagtgtgggcctaatatataaattttgaggtcatcaggataaagatgttattgaatttgatgtgtgtggatcagaaaaaagtaggaataaaatttaagaaaaaaggttagagctcataactaattttaggaacataaacatttaactgaggaattataataatggaccatggaatttggggccagataatgaagtgaagtcaggagaggattgagaaatagtagggaaacgtgagttcactgaattgggggtctttatgtgatcgaagagcacaggcgtgggtgtgattaaacaatgagttggatgagtgggttgttagaaatcctaactaattttctgacaaatgcaggctgcagttttgaccatgcggaagagagactagacttcaatgagggaaataatttggtaatgagtaaataaaagaattaagagatcagctgtattggatacttcatgtaggtggattttgaatataccgagaataataagaatttgaaaaaagagcaaaattaccatccagtagtcaaatatttgaaaagtaaaggcttctcttcctacttaataaaacttttgaaccagatttcattgaatgacagcaattgtagagagagagagcctggtctagcagggtggaatgagtctcagaggagcagtagttactgcacaaggcaggggaaaaaatggtgtggggacagcaatgaggggcagggaaaacaccaaatgtgcctctgtctccaagggatgtggaggtaaatgaaaatagtctgtaggaaagagagctgaaggctaagcaatgtcatcagggtacagtccagcagagcagggagataaaatggtcattctaaaaatcaggtgaagatacgaaacaacgtgccaatctctgaccaggacttctctaacacacagtggcagtgtttagaaagggtcagaataacaggaggtgaggctgcagggtgcatacaactgtatagagataaggtaagtccacagagatgggaaggaagatgaaaataatcttgattatttcttagttgagtgtgggcaagctgacacatggctgtcatgtctaaaactcctttaggatagctctcatgggatgactgttgttctccaggggttggggaagagggtgagcacattcctaggtggactggcatgggagtatcctaacttttctcactctgtaatagcttcctctaagataacaggggctttgcccataagcaaatagtgaatagcagaaccaattgttgcaccttggtttattcatagcagcacagtctgccataccatgtgcaagtgccttcgataaaatgtgctaatgcatggaatctttttgcacttagttaaacatacaaatttctcatagggcctaatttgcagagcctcacaaaaattggctcctcaccccttttttattcagatcttgttcaaccaactcactcacttactggatgtgacttctgtcacactgttgccaattatcctcttcctgaaacactccaatattatgttggtctcagggctttttaccatgctgtgtccttggcttgaaatactctgttttcagagtttcaagtgtctagactctttctcatctgttggattatacttcgtctcttaccttctctgaaaagactttcaggaaattacttaattttgtcttctcttatcttaccgagtaccttgcagttgttttcttttctattgacctattttatgtttttataccacttaggaggatctgataatatgtgttgtatttgtttaggcatttgttaactgttttcttctctttatcatgaacttcatggctcaaggatttctatttatatagaggagggctggctcacaataggtgctccataaaattatgttggatgaatgcataagcacttgataaagatcactttcttcctctctctctctctatttttttttctttttttttttttttttttgagacggagtctcactctgtcacccagacttgagtgcagtgagcaatcttggctcagtgcaagctccgcctcccgggttcacgccattctcctgcctcagcctcctgaatagctgggactacaggcgcccgccactacgcccagctaattttttttgtattttttagtagagatggggtttcaccgtgttagccaggatggtcttgatctcctgacctcgtgatctgcccgccttggcctcccaaagtgctgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatgtaagtcccttccctcatgatttattagtttgttatgttgctacaaggtttactcttttgttgatgtatatgaaataactacaaagagtagtgatatatttcaagcatgtatttccttcaataattttatttaagctagatagtatttgtcactaaatgtaaagaatctaagagggatatatagccctatatatgtaaacagattaaattttccacaggaactgagagatggaacattatctctcttgattattacatttcaaagagatacttcccaggtccttgagaaaggctttcctgggccataaagttggcaagaggcttaattagcttttaaaggagttatatacatttttaaacagagagggagaaatgacctatgagtttttaaagtaagtattctaagaaaaaggggtgaggaggggtgtttctttccttattttcagttggaagaatcaggcctttttttagaatttagtatttaattagtatttagtatttttaattagctcttgcaattgcaagtctttgttattttagaaataacatgtttgtcaccttcttattctccatccctctttcttaagaggaccttaagcatacagggtttggtatgatctttcaaattcattatgatctaaacaagatggttcttggtggtacaatatgaagatgcaacttcagatagacatcttaacttttaaaaagtataatttataaatttagaagaggagactttgtttcttacaaagggttgcagcatgcacggtggccattcagacaggttgggaagcatagtctctggttggaagccaaaagcagatactttgagggaggggcaaaaggaacaggaatttatgctaagcaagatggctgaatatatatattatattttccccaatgggatataggagaagtcatgaatatttatgaaaggagaaacttgtgcatgaacatgaacatgcctctccatggattccatgtacaaaaatggtggcattagcatggtgtgagggtggagttttcagccctatggcatcaaaaagtgaagcacaggacatgaaaatccttactaagcattctctgaagatggctatagccattcaatggtcgtggtctaacaggcaaaataaggaaaggcagcatcaaggttggttgatatcactggtgaagtctttcgaaagggctgttttctgttttcagtggtgaagtcttctgaaagggctgtcttctttagggaaaaaagtctaaaggcagttagtgagaggttggtgtataatgaggcctcctgtcatggctgagaatacagttttcaaggttactatggggttccctgggcagggaaaaggtccattcagttgttttaggggctttggatttatttttatttctcagatattaggagaaagtgaatttctgaggcattaggtattgttagtccttgaaaaaagaccttttccctgaaaacatcatcctctcttctccactttcccatactcggtagggctccataaaatagtgtgctcgtgagcacttggtaaggcaaaggtgagttcaaatcctaattcttcaactatgcagttgcatgccttgaaaacactgccttaaacactttgaaacttaactttctgaaacataagatagagataagttatatcattttaataattaggaatgatatataggaattttctaacacagcgtctgacatatagtagataatcaataaatagagatgtaactaataagcccaaacttagtgtcttcttacttgttctgtcttctactatagtatttatgagtgtttgtgttgagggctaaaacataaacatttagatggtattacaatgagaaatctgtagggactatagcactataattattaaatttgaatttaatcatagtcagtgagatcagtattaagttttagtagtgaagtttattaactggatcctttgctgtcacaaatataccagtgctttcctacctaaatgacctatatgttgtgaatggcagttttatattaagattaattaaacatagagaagcattagtagagagtcaaattcactgttcgatcaacaataggcaagataaagaaaaacaaaacaaataatatttagggtacaacaaagcagggacacccttatttttttgaaaattactcttaatattaaaacaaactcaaaatagtcattatagataaaatcaaaacatttttggaccttcttatacttagagtttgatatttcgcaaatttgaattacacatacaggggacaaagctcttgacccctaaagttttgatgaaaatcactgataatgaggctgattaattaataagagaaaatacatacaaatttatttaacttgtatatacaggacccttcagaatgaaaactcaacttcccaaagaagtacagaagcttatattactatcttgaggttacaacgagaatgggggcttggatcctggtaaaatagtttatgagaaggcaaagagaataaattttatggaggggcaataaatgattacaacggaacagaaattaagttgtaaacagtttcctttttttagaacttaaatgatgcttgaagacaatgattatcttgcaaaagggtctgttcagatgtggttagattttttgttttctttcctgtaatggataatgagattacagggagggaaacaagaacacttgttctcctaggcaggtaaattctgactttttgtagataggaaaaaaagtctctcctagtgatcatcgattcccaagaatttttaacttaaaatactcattataccaggaagccatattttggggtgaaatattttgatttccttcacatgtaagactgaaagtgaagagattcattttctttcttaaatctttgaggatcttactccagcatttctcaaatacattttattctccttatatttatatatttttaagagacggaatctttctgtgacttagactagggttcagtggcataatcatagttcattgcagccttgaagcccttggctcaagcagtccttctgcctcagccttgtgggtagacatgctaacatccctagctaattatttattattattattattattttagatatgtggtcttgctatgttgctcatgctagtctcaaacttttggactccagggatcctcctgccttagcctctggagtaactgggattatcgacatgagccactgtgcctggcttcaaatacacttgaaaaaataaattttgtggaaactcatagtttgatacattttaaaatgttaataatatatgtcctactacagaaaaaatatggaagcaaacaatctattttgtttttcctttatgtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctattatatacttcctgcctttaatatcatctccaggaatgcatatatacattttagtcagattttcatttaatcagcaatgttatctcaaagctttctcactgaaatcattgcagagatactgaaagattacagtatataatttcaagtactcatgttggcctttaatttctttttcatagtcccctgacacctgatggtttgcacagtcctcagttctttcctcttgtcaactgtttaatgtccatccccagagttctctgctggggctgtactccaaaaagctttttgtgccattttattcttctgaaaagcctactttcttcgacacctataaaactactacctctggcacttaatcatagacattccttattacttgaaattctttgtcctttcatctttcacacagactaatcccagctggaggcaaaatttcagaatatccttaagccagtgttctgctggtgaatctctgacctactgtcataatgctgataaaatgtgtgagggaatactgagtactcacattcaacagatctacagttacttcttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagatgtggattaaatgttaatatctgagaatagagcaggactatagccttctttaacttagttaaatacatcagtgagacagcagagtttgggtatatttggaggagacacaacagaaggaaaaacgtaatgacaggaagtaggaaaaatttaaatgcttcaggacagtgatgcagatccctctgtagatattaggcccctcatgcttcagtgtatgaaaagctcctggcactgatggataatctcatgcctataaatacaaatttttcctttttaaaacctgagccctagtcaaaaaactgctacttaacctgggttgcaactaaagaaacagcatacaaacagttctaagactgagctacttaatgggttttcaaatcagatttgagaagtaaactctaagttgggacatgaatgcattgcataggccttaatgtgctgagtggcaaataggaaatactcaagaaaagtagttattattattattactattaaaattattattatggttaatgtatccaaaaaggtgccaatgtttttgaatgttgctatattttgtctattcaaccccatgagctagtttacaggattactgttgaaccatgattatatttaaaacaaataattgactaaatgtgtgctataatgttatcagagaaaaggggcatttaaaaacagatttttaaagccacattatccattcctttaccccattagaattgtgtggactatgagaagttatctaaatagtaacatttaaagtttagctcttttataagtgccaaacatctttacaacttctttgtctttaaagagatttgtgttttaatataattaaccatttgatgtaggtaaaagagtgcatcgggcaataaatgcttactttttaaattatgttcatttttgtagcttcaattgtgaaatttgagaagtaaacaaaacttgatcatttgacaggttttcttaaaaaaccggaatgagaaagaaattctgtttcagcttagaaaacaactatagtaaaatgggaagtctgttggaatctaattcagtattttacattatttttaagaagactcacgatgccacagatttccagctgtctgaatgcttcccagcttgctgccttggcattgcaattggtatttaatattatcaagccttttatgattcataaatgagccttggaggacctcactacactttgcttttgcctcctgattgctcttttattatatgttggaaaggaaatcaaatatttgtttttcagggaacttaaaaaggctccaggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaaacccgtctctactaaaaatacaaaaaagttagctgggtgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggcaaaaacaactaaaatcacaagtataaatttataatttcctatgaccccaaagtgacaactattaacatatttgttaactttgcttcaagtgtctcttttaatgtaaaagttataaaatattacagataatgttgaagtgccttcctcaccataattgtcttgatttagtattttccacatcagtcataaaatataaaactacattttcctcatccctctccaggtgtaaccaaaattgttcaatagtaccatgtaacaggattatatcatttttatttagtcttctactgataaacattcaaaatgctataattgaagatgcacatcttatcttccatagcacctatgcaaaagcttttccataatatatgcttatttcacattgcatgcctgtagtaaaacatctcatgtaccccataaatatgtgaaatatatgaacaaggaattgtttatcatagttcatgtattttctttccaattttgttagcaacctcatccgaaaaacaaatttcattagatattaaaaagatttttctccaaaaaatttttactaatttacatttctaccaatagtttataagaatttctattcctctgcaaaatcattagtacttgagattagacatttagactagactattagagtacattagactatttgaatttggtcaaatagtctggggacaaatagaatcaaattgctttaattttcagatactcataactagccattctttttctccatatttataggctttttaatttccccttctttgaattccccatttacttcattccttcttattaacatatagtaatttattatattttctgaatgcctataatgcaaatattttccccagctaagactttatctcttaatttcattgtgtgtgtgtgtgtgtgaatgtgtgtgtgtgtgttttcatatagaagttttaaagttttagtttgtcacatttagtcattttttaaatggcttgtgatgtttgtgatttgttggaaaaattcttttttaactgaagctcaaaaagatattttcctattttttaatattcttaatgtttttgtttctcagatttagttctttcatccacttgtggtttgtttattaagtccatactgattggacctcaacttaagtgaaagcctgaattccttttacgccctttctgaagcagtacctccccccaacacaccaaattctgctacaacatgtatgccagtaattttctcttctttgtaaaaaagcaacttgaaaagcaagtaatttttacttttaaggagacattctgtgattataatctcagacgatagagacattaggaattatgaaaagtatataacattttttaaaagggctaatatatttttaaactttttttctcaacgtgaatttaaacagtgagctgttgaagatataaacaaactggtttcagtgacaaggatattttgaaatttaatccagaaacatggtctatcacagatcagtgtaattctgatttatgctatactagattatgattcattagaaattatcccaggatagagcctcaacaaccatttattgaatatatattctgagaaacacacagtaaccacagcagtaataatagttctcaaatataaatgactatattttattaaaaaaggtatgttaagtgtttaatttttctttcagtactaatataataaagaatgtcttctcatgcagttccaaaattaatattatgtttagaaatatttatatatatttttaaatttaaatttttttttgctgtgatgtattctgagaatacttaaaagaaattgtttccctaataacaatcttctgctaatttgctattaattgcaaaattatagcaaaaaccagagctaaggattattttatttggcaattgtatcatgaattattgaataaatacccccaatgtacactattaagttcctttaaatatgacttctgaacttaagctacttaaaatgtctgtaaaaaatgttttggtcataatttgaagattgagagaaagtaaaatactaaattgacattatagagacctctataaatggagacttctggacactcctatccatcctattaataattttgcccctacaaactggaagcaactaatttgttatgcagtacagagcattgaaacttttccttactgtagtcaggaaatgcttcttaaaaaaaaaaaaagcttcaatgtcttcttaaataaagaaaaacagtttggagtagaagaggcgtgaaattgggaatttcatcgctcaaacaaaatgtatgtaaaaatgaaaatagaaatataaattaagggcaagggaattctgtgaggaagcatgtccaaaatctagtattatttaaagtcagtaataaaaattttgtatgtaatttaaatagtaaatttacaatgacactattgaagcagtgggccgaaaaatttgtttatctgtggtatatggaacatctgtgtgttattaaataataaatactgatttgcatctattactaccataacagcagaataaatgtaactgaaaacagatataaaaaagtggcttttttaaaggtgatattttctttagagcatagagcaaatctaaacagaaagacaaaaaagccccacaaaactttaaaaaattaaaaaaaggaaaatcatagcatgaaatgtattaatgctatagaaatttgttcagtgtgactggattttcctttcacattaaattgcataaagtttcttttcaaagtaaatttgagtaatagaaatttcagaaaaaaattgctcaaataagatattcttcatgatattcccatgtggaaaaaaattcagtattattcattaagcatttttgtgccattcacatttttaggtactgagaaacatacaaaccctgggtgagatgaacattaaatacattttatatactttagatagtacaacaatagagatattctgaaaatattttgggaaacatgagggagtatatctaattttgtcaagggaaagggtcagggaagtctttaagcttgaattatgaaaaaaatgacagatgctttttcaaatacactatttttagtgctgcagttcatttaattgaagcacgtattctacctgagggatgttatcttatgtaacaccacacgtgaccaaaacggtgtacttggtcaggtttatttaaatattttgaaagccaattcaatttaaaatgaactgatatgattcagacaatttgcggagggagaattaacataaagaaagttttcacatcttttctcctaagaagaaaatagatctagttttctcaattaagaagaatttattgaaaatgtattggtatgctaatatgtaattacactaacattaaccactgttgttttgtgccaaaatcatgtgccttcatccatataatttcctgatcacatctaattgcattttaaggttttgtggctcttctaggaaattcagtttgcaaaagatatggccactgaactggagtttattttttacgtattttattatgatagtcatctgatcaagtcttttgtattttttaaacattatccaatttggatcattgaaaatcagaagtaatgtctgtgggaccattatagagcaaatagtctcactgtccagtgtgcacaaaacactggcttttgaggaaaaaagggctttatttgccttttttcgaataggcaagtagtcagcaaggagacaggagtggattcaaatctgtctcctcaagttagggaccccttgcttctgaaagagttttagtattcaggttccagtcatgtcccagttttaccggtatagaggggaatattgattggttttgggtgttgttagagatcaaagctttttctattgtgcatgcctaggctacatgaactgcagattttggttttattatatctgaaaggtaactcaacattttgttaccaactaagcaggcccaatttgggctagtccagtaggtacaggacttattcaactaaaaattcaattatgaatttatgtgacagtatttagtttaatattaaacagcattaaactatcctttatgtccttatattttcacttccatgaaaatgaatgattttgataccttgtaatctactaaactatctttgttcactgtagattaatttgcttttaccaacatttagatttaaaatattctcattttactttgtggctttcaatacatacatcattaaggtcctttcctagttagaatataagctgtgggagggcagtaactatatctctaggacttagcatgatgcttaatacacagtagaaaatgagtgtttgttgaatgcataaatcctgtttttccatccaggccagtttgtccaattcaatgtataaaactacttataatcaggaatatgccacaaatggattttcccaagcattatattttattgatgtacatgttttgtttcctctgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaagtagagcactatgtcatagctatcgaataatagataaaggcattctgaaacacataatatttaaaacatagactcataaaaagtcattttcaagtatttcttaagcagatactgtcagatatattggacgatgagataatttgagagcacgtgttctgaaaaacagggtaagacacttggacaaagaagttttatctttaaatcctgcaaaataaacatacacaaaaatcagaatttttaccaattatattggcgtacttcaaatgagatttgattacctatatacactatcaaaaatagcatttttgtcaggcaggagcagaaaggaaatatagtacatgctgtaataaaagtataatcaatataaaagtaaagattttagcatcagcatgtgaagaaaaagtcatcctgggcaacacatggtttatcttttaaacatcttaataaaatctttttggatggatcatttctagaatgtattacatgtatttactctttgaaaggacagtgagaataaaccaaactctagatgaaaatttcatgtctgttttgatgctttcataatcattctatttatatatttatttttttaaaagtatttcatgaagtgtcttctttttctaacttttattttaaattcaggggttacatgtgcagatttattagatggctatgttgtgtgatgctgaagtttggagtgtgcatgatcccataaccccgatagtgagcatcacacacagtaggtagtttttcaacatttgccccctttgccccaactctagtaatccccagtgtctattgtactcatctttatttccatgtgtacccaatgtttagctcccattataagtgagaacatctaatatttggttttcttttttggccattagttcgcttaggataatggcctccatctacacacttgttgccacaaaaggcatgattttgtccttttttatggctacgtagagttccatagtgtaaatgtaccacattttctttatccaatccattgttgatgagcacctgggttgattccttgtctttgctattgtgaatagttctgtgatgaacatacaggtgaatgtatctctttggtagaacaatttattttcctttgggtgtaaatccaaaggatttggtgagtcaaatgatagttcaactcagttctttgagaaatctctaaaatgctcttcacagcagctggactaactgacattcccaccaacagtttataagtgttcctttttcttcacagccttgccaatatcagttattttttgttgttgttgactttttaacaatggccactctgactgatgtgagatggtatctcaatgtggttttcataataattgtatacttcacattgcaatcacccaggaatataaaattcgtgtctatccaatttcttattcatggtttgacctagaaatgtggccaacattaacccagtaaccatttactgtattagtccattctcacagtgctataaagaactgtttgagactgggtgatttatgaagaaaagaagtttaatcgactcacagttccacatggctggggaggcatcaggagacttacaatcctagtggaggggaagcaaacatgtccttcttcacatggcagcagcagggaaaaatgctgagtaaagcagggaaaagtcccttataaaaccatcagatcatgagaactcactcactatcatgagaatagcatgagggtaaccacccccatgattgaattacctaccatctggtcccactcaccgaacatgggcattataggaaccacaattcaagattagatttgggtggggacacagccaaaccatattaccatcagttttattctttcacctctttgtaggttcaaatgagcactcatcaataattcccccttcccatcccctctgaatagcatgtactcacctcacattgtatctcatctttttcatcttattccctattatcatttacttactccataattcctcacataaattatgtttgttttctacacaaatattaaatagattaagtaattttatgtctgttttcaatgagaatttaaatcctttgaaagtcagaattttaaattataggttgataataagctgatttatgagccgagctttatgaactgagaaaaacattgaacatatttaaagcagggttcactccttagcagagctgcaaatgacagtgataccatagtgaagatttcttgattctggttctgaatcttagttatataggtccccaatgcttattatgcatttatttaggaagtattgaggtagttaaacacaagtgatttttaaactggacattaattttttttaaattatacattaagttctagggtacatgtgcacaacgtgcaggtttgttatacatgtatacatgtgccacgttggtgtgctgcacccattaactcctcatttacattaggtatatctcctaatgctatccctcccccctccccccaccccacaataagccccagtgtgtgatgttccccttcctgtgtccaagtgttctcattgttcaattcccacctatgagtgagaacatgtggtgtttggttttttgtccttgtaatagtttgctgagaatgatggtttccagcttcatccatgtccctacaaaggacatgaactcatccttttttatggctgcatagtattccatggtgtatatgtgccacaatttcttaatccagtctatcattgatggacatttgagttggttcctagtctttgctattgtgaatagtgccacaataaacatacatgtgcatgtttctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcatcttttcatgtgtcttttggctgcataaatgtcttctttggagaagtgtctgttcatatcctttgcccacttgttgatggggttgtttgtttttttcttgtcaatttgtttgagttcattgtagattctggatattagccctttgtcagatgagtagattgcaaaaattttctcccattctgaaggttgcctgttcactctgatagtagtttcttttgctgtgcagaagctctttagtttaattagatcccatttgtcaattttggcttctgttgccattgcttttggtgttttagacatgaagtccttgcctatgcctatgtcctgaatggtattgcctaggttttcttctagagtttttatggttttaggtctaacatttaagtctttaatccatcgtgaattaatttttgtataaggtgtaaggaagggatccagtttcagctttctacatatggctagccagttttcccagcaccatttattaaatagggaatcctttccccatttcttgtttttgtcaggtttgtcaaagatcaaatggttgttgatgtgtggtattatttgtgcgggctgcgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtgccatatgaattttaaagtagttttttccagttctgtgaagaaagtcattggtagcttgatggggatggcattgaatctataaattaccttgggcagtatggccattttcacgatattgattcttcctatccatgagcatggagtgttcttccatttgtttgtctcctcttttatttcgttgggaagtggtttgtagttctccttgaagaggtccttcacgttccttgtaagttggattcctcagtattttattctcttagaagcaattgtgaatgggagttcactcatgatttggctctctgtttgtctgttattggtgtataagaatgcttgtgatttttgcacattgattttgtatcctgagactttgctgaagttgcttaacagcttaaggaaattttgggctgagatgatggggttttctagatatacaatcatgtcactgcaaacagggacaatttgatttccttttttcctaattgaatacctttatttctttctcctgcctgattgccctggccagaacttccaacactatgttgaataggagtggtgagagagggcatccctgccttgtgtaaactggacattaatttttaatctgagtgtaacaaggatgagtgtttcccattcctcttaatccttgttgataggtgcaattagaagccaatttacaaatcggtggacaagaaaccaaggacaaaacctcaataagagatctcttgtcctttatcttgggggtatttctttttaagtactatcgctagtcatttagaatcggagcatcctttcttagagataataatctacacatactattttttctttcattttgcttggtagaccatcatatatctgctcagccaaaacagaaatgtctcaaagatgttacagtgcaattgagtaggctattttttttttacagaaataactacttttcctaacttaagaaagtagtaacacagtaattatttatttctgatgaaaatttcatttctgttttctaaatttgctttcttcttgtttttctctttacttcttttacattgaatgagttttcttttgactcattgttttttcccctccattaattggaagttataagctttatttctctttattctttaggggtttttatggaaattttaaccagcaaagttaacaagatattgataaccaatattttacccttcttccaaacaatacaaggaccttaggaagcttagactgatcaaccattctgctgacatctgctattatattagttctaatctgattctttcgtgtttagattgaacatattttacacacttgtttgctttacttgccatttattatttatttcttcttatagacagtcttctgtggagtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctccttataatgtctttaaaatgtttgcagaagcttttcttaccttaggacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctgaaagtgccagaggcctgtcaccattgttggaagcttagcaaagttcaaagagagcttatcaatgcacagtgagatttaatgtgcactactcattatcctggtgagaccctttgttaaaatagtcaatttctatgctgtttgtaaggttgtgcagttgtaattcctggatgactgccagaaatagccttagtaacaaaacacccagcatccttctgttctcaaatcaatcagtcattgtgtaaagaactttttgatttataatgaatcttgtggccagtatttttaggttatttcactacactaagtcaacagtatgttacttctaggtatgttattataaatggactcattcccctacatctctatacataagcttcttatgttatggtttgtcataacaggtgaagttgaatttgttaattaaaagagtatgtaatatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagatgtttatgaatacatacagttggccagttggccctctttatccttgggttccagattcaatcaactagggatcgaaaataccagggctagggaaggatagttgtgtctgtactgaacatgcagactattttttgcttttcattccctaagcaatgcagtataacaactatttacatagcatttacattgacttaattattataagcaatctagagatgatttaaagtatacaggaggatgtgcataggttatatgcaaatactatatacttcatataaaggatttgagcaccgatgaattttggtattcgacaggggccctgaaacccatttcccctggatatcaacagatgactatacaaatatgacatttatgtgtgtatatgtacgttaaaaatagttttaaaagaataaaaacatctgagtacaaaataagtatttgaatagactaagattcagtattttgtcaaggacaacaactcatgtttaaatgtcaatattaactttgataacttagcaaggaactgatacatctatgtttgctttttttgttgagctctatttttcaattcattgttccttaatacattttcattctatgtggagagataaacagtccatcaaatgtattttgttttttaaaaggctttgtaactgtaacctgtagaatgacttgggaatcagccaagttttcaaatctccctccactctttatttgaagtgtgatcttagacaacttggttatgttctctgagcctcacttctctcacttaaaaaagggcattgatgaaagcacacacttcatagtaatgattaaatgacctaaaatgtatgaagtgcttagaatcgtgccaggtatattatattatattatattatattatattatattatattatattatattatattatattaatgtactgaataaatgttagctgtcatttgtatttttttcttgatggaaataatagcaaaatttctgatataaatgaaaacataaactcaggcatctcacttcctcaaccatttacccaatttcccatggaaattatcaatagagtaaacaaataagtaaaagtttgcattctcaatggaatctagggatggagccttcaaagtgtcaagtttttttttctatttagtctagtgcatataaaattagagtgaaggaagaatagaaggttggtaactgatccccttcataaaatatcagtgtgtctgagaattacatgggaggccatgagaaattgccatttgtattcccagtagtgttttgttttaaacattaaaagattctgtgttaatctaaacacaatatacctcacaaatttattactattagatattttaaacaattttgagactctctggtctgtttaactctctctgtatttttatttccagaacacattgagctctgttgactttctgacttatcacgctttctcttacaagtcattcgttatcgtctctgaattctcagtgtcctccattatgagtaatctcccttcattcctaatctttcttcattatttgctatcttgtttcacttctcttctattcaaactgctcattccgtagctctgccagtgctggctgctctgtctctcacactccacttattttaagagtctggttcagattcttttgactacctggatcaagcagtatgtactgattattttactgttataaactcaaaaatcttagtagtttatacctacagagattgtttctcattaacactgcttataaagcataggtcagctgaaggctctgttccatattttctcactcaaggactcaggctgatggagccactaccacgtggtgtgcttttacttctgggaagcgaaatgagagaacatggtgaactgcagaccgtctctcaaaagtttctttgcagaagtgaaagtacacaacttctgcttacattccttgatcaaggtaaaccatattactgtgctcaacttaaaggtaagaaaagagtacaatattccatgtacacaaagaaagacaaagtggaatgtagttaaatagccctaatgcttaacctatttcccattgctgttttaattcatggtttctctagaacccagaaaaaaatacatgcttctttgaggctcatttctctggatataccattcctttcattcttatgttatcacctactcactttctgatcacaattacatatgcaccatttattttgggaatggactcatagcctttcactttaagagagccaatttcatagttttatttgaattcagtgtccttacggaagactcatccattaccctggactctatgcttcttgggttcttgaacctctcagccacctagtcctaaagtcacatcatagtcatgatcataacctaaaggacagcgacaattatatcaataatctgaaaattcaaatcatttctgcttgcttgttaatttggttgatctcactacatttttttttttttaccccatccaacccctgagttgggcaactggaagaagctgtattagcatgaaaataagtagccccagaactccagaaactgtgtgcctttatgggctgatactcctatttcggggtaggtaaacttggaccacagaagttcactttcaaatggaaagtgaggtctcacgatttcaagcagtgaaactcaaaaactcagccagacaggcatcagtgacgttttgactttacaagaaattggaggaaattttgtccaccaacccatagcctaaaaataaaactgctgactcaatagggccctagattcatatggcttattttaaataaccgacaagttgaaacatcatgttgtcccttggactactgtggctatctagtgtcagagccaactacacaaaaactaaactgaatgtgatcattctggttagtgggcagaactcaaggctattcttatgtctagctatgatccttgagttgtttccagtgacctgaatatttggtttgctcatcagactagcagattaaatatacccttctttggggtaaccaaatatagaaaaacattgtggctgctaattggacagtttgggtcactaatgagttcagaatctgtgtttatttactgctatattgctctttctcactcataagttatctcaaatattccataaatcttctcctaaccactccactgatctcttgcttatataatttattgtgttcttatagtttctctgggtatttcttgcttcaaagagttgtgtataagctctgggagggatcatgtttaaatatcttgacattcttactctgccaagtctatcagtggatactgattaatagattctgtcatattatttcacagtcgagaaaatagaaatttactgtattttactatgagatatatttatatgaactcttttaactagtgaagggatgataattaccttctgaaattagggatatttaacatttttataattttgtcttagttccaagtcttatttttatatctaaacagaagagtaatttgattgattattacttcattttattcctggaaaaactgcatgaacatatgagaataataagaattggtagcattcaaacatagtagctaacaacatcccacaacatattactttatatttgatatcagagattccatctgaattgtttcaattaaaatatatttataaaaagagagcttagttttccttgtcctcaaaatatgcaacatattgtcttcatttcagcaactaaaaataaagcaaaacaatcactaaactatttactcatttcatgtcttagtagtttattttcagaaaagagttgtatttgtactgaagtcactctacaaacttaggccaaataaaactttttatatatgcatctcaatcttcaaagtcttaaatttaataaccataaaaaattttgtggacttactttattgtttatagttgtgttttatttgattaatgtttttcaagtacttgtttgataaatatataataacattacattttaagtaatagccttgttttggttttatgtatgtttaaatataataattatagaatgtaacaccatattttatatataggtaattatctttggcagaataacttttttcacttaaattgtgatttcaaaagatgctaattacttcagaatcaagaaatcagtaatagctaaatcagaaacagaaaatattagaaacattgtttagtgcagcactatgctcatgaacaataaaaatgacagacatagtaatatctattataataatagaaataatacatatttggagtattgatatgcaagatctcagattatttttaaataaaagtttagtcttttaggaattatcactgtgaagaaaacaggaaatttctgcgtactgatatttttctagggaacaaaagtaacttgtctagtgcattaaatataaattccagctagcctgtgcaacattatcagaacacatctctaaaaaaaaaaaaaatagaaaaattggccagatgtggtggtgcatggctgtagtctgacctacccaagaggttgaggtgggaggatcccttgagcccaggattttaaggctgcaatgagctatgattgagccactgcaccctaccctgggtgacagagcaagaccctgtccctaaaaaataaataaataagtaaataaatttgtcttagtccattttcacgctgttgataaagacatacctgagactgggtaattcataaagaaaaagtagtttaatgaattcagttccatgtggctggggaggcctcacagtcatgggggaaggcaaaaggcatgtctcacatggtggcagacaagagagaatgagagccaagtgaaaggggaaaccccttataaaatcttcagatctcatgagacttattcattactatgagaacagtatgggggaaaccactcccatgattcaattatcttccactgggtccctcccacaacacctgtatattaagggagctacaattaaaaagagatttgggtggggacacagccaaaccatatcaacatttattccatggaaatattataataattctagtatagagaaatattaatatttatgaagcatacaattgagagtgcacaacaaaatcagatttgggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaaggaggtgctgaagcagcagctaaatctattactttttttttttaaatgatttcctattcatgccctacaagtgtgagggaaatctctgaattttataactcaattgcccactttactttctttctgttgggcactgtgtggtaactacttggtttggtgaaaatgaactaaattaatatttctaaaacataagtttatgtttttgtaaactgcaaatacatattagattttgtatagtatgggaaatatacaatttaaacaagtttaatttttttatattttaaacttacgtagctttaatctcatcagttttttcttaaacaatacctagtgagtgctgacataaccatatgcggtaacttgtttatggtaataactaaaacagttaatcacagagatatttatgaaacattttagcagttattgactattatttatcatagcaaaaattaaaaatcatgcacataaaaaatctcattttttaaaattattttttatccttttatatgatcccagtattaaccatataatccagcatttctcattcatgctgccagagatggagacctcaacagaaacagtgggctgaagttgttggagagatgggagggttgaagtacaaggacgtttttattaaatatccctacctttactactatgcggtctttacaacaaaaatgacccaacagctaatctaaaagaagtatttgggtgaaaaaaaatcaatgaaaatacaaacctcaagagtattctctttggcaaataataataataataataataataataataatataataaagggggtcctgagggtagaattaccatgtgcaatagtgatagttttattcattcaaaaaatagttgtttagtgactactttgtgccagtcactgtactagacactggagttacagaattgggcaaaacagtgaaactccttactcaaaaggaacttacattctaatagaaaaagactgacaagtgacaatgtctgtttatggcacatttcatgaagaaaattaaagtactgtatggagataaagagtgatagaatgagtgttcaggaaagacccctttgagtaattgtcaggcaaatgtgataaccactatgctctggaaaccccattgcgaaagtgacatcaaagcaagcacatgaatgaaatgaaagaataagccatttgtgtgtataaagggacgagctttccagggagagggaatagcaagcgtaaggcctggaaaaaggaatgtgtacactcacttgaggattagcaaggcagacagagttgttgaaacaacagtgagaaagaccagaagaatgatggaactaatgttgataaagccatatcttgcaatgctttgtaggcaaacatgttctataagtcattggaggatactgagcagaaagtggtaatctggtatgtgttttagaaagaaccttctggagttaggatagaaaagagattctagttgggcaagaatgaaaataggggaccagttggagtccattgtaagagttcaggcaatgtgactaggttggtagtggcagagatggtgtgccatgtgtacagaagttgagttgtgttttctttcaagtgtacacagagacaaattatttgttcacattatgcattgtggagagtttaggaatgcgtggtattacttacatgtgacattatattgaatatggataattaactagcttaagtgtcttagttagaataaatattaccaatttattcgtatgaacttactactttaattattttacccattttattaagcatttaacaacatcatggaaaagaaaacaacgtttagaactgattttccagcgttaaactgcaagaacctttagaagtatgcataagatgtttcactgatgagatcatgtattataaaaataagatcattatgttctttgatttctgaaacttcataaagaagaaagcttcacaacatattcaaatttggagtcattgtgccattcatgaagatatgctttgttatctaatttttggtttaagtttccagaaattagaccaataatttttaccattgctttataagatataatcagtagattgctattagttatgtaactctgtaaaaagaattaatctgttctatctagatggttagttcaattgaaattatattattgtacaaataaattttatttctagagtaagactagaaaaaagtttcaattaaaaattctctgagtggttttctttgaaaattttagtaagttaaattgaaactgtattcagcaaacatttactaagcagttccttggtgtcaaattttatcctatgccttagggatgttaggttcattatgatcacaaagatgaataagacaatttggaagagtttcacatagaatggtggaatattaaattagtgcttattaagttaataagatagctgctgtgtaggtgtctttgttagatttccagggagggaaactttaccattccctcagtttagagttacatgctttgatcgaagggtatgcctgccggctttcaagtgtttttactctcacaggaactgagacaatacagttacaataatatgtgcattcaaatttctcatatcttattggttgacttatatgtgaaataaccagaaataacacaacataaattattgctacatgttaaattacatgattctgtttataaattatatacaaattcactgaagagaaattaatgtggatagagtattcaggaggaaaagaaccagagatgtgtcttatagaattcgaatactagagaaaaaagaatatcattttgggcagggaaataacaaagccagtaaaacaacagaaatggatatgatatatttgaatggttgtacagaaaaatagtgggaaatgagcattgttaagtcatctttggagccatactttccttaagatctcaggtttcgggttagctattctggttttgtttttcatttgtaaaaaggaaatcacactacaaattttgtagggttgtagtgagtatcaatagaggtgaaaatcttccaaataatatagcacatttttccctcataatagacacattaatgctagctattactatgatattcatttttctttccccttccaccttcccagtccagggctgcaaacacagcaaagttgttttaacacaatatatctactaactgaggatatggtaaaaacaacatattgttatttaaaaatatataatttattttttagtgaaatttgaggtttacagatgaattgtgcagaaagtagactttcctggaccccctccctttccatttccatacacattttcccctattattaacaacttccattagtgtagtacatttgttacagttgatgatttattattgatacatttatgattaaagtccatagtttacattagagttctctctttgtgttgtacaattttaatgagttttgataaatgcataatgtgtatccaccattatagcatcctacacaatggtttcaccaccctaaaatccttctgtgctccacatattcagcactatctcaattcttttgaatccttggcaaccactgatcttttactgtctctataattttgccttttcctggatgtcatataattggaatcataaagtacatggccttttcagaggctctgaacttgaccctctaaattctctggtgtctttcacttagcaatatgcatacaagtttcccccatgctttttcatggcttgaaagctcatttatttttataaatgaataatactattccattgtatggatgtaatacagtctgtttgtatattaaacttttaatgaaatgtctgaatgtgtctatctgtatccttttttttaagtggctaatatctttcataattaaaagtattatagtattacataatttctatttttctctttcatatttggaatagaatttttattttaagcaatgctaaataaattttaaaatttaatatatgactattcaatcctattaatatattcctatattacaacttttttggaataatgtagctgtgttcttttaatatgtgttatttgaatttttttctaacttttttgctgtatatgaattagaaatattttaccatttttcaagaatgcaatatattattacctataataatcattttatacaatagatctcttgaacctatttctcctatccaactgaagttttatttcctttgaccagcatcttgacaacctttcccgctacccctataatcagcccatcccctagtaaccaccattcttctttctacctttttttttttttttttttttttggagacagagtctccctctgttgcctggctggagtgcagtgttgcgatctcggctcactgcaacctccacctcctgggttcaagtgattcccctgcttcagcctcccgagtagctgggactacaggcgtgtgccaccacacctgggtatttttttttttgtattttagtagagatggagtttcaccatgttggccaggatggtctcgatctcctgacctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtgtacgataaatacataaaattttatctgtcaattaaaaaataaaaagttaccactttatagcatattcgcttatatggtttgtatgtgacaaaattttgcttttcatgtgcctaagagaaaggaggttacagaatgaagtaacacatacataaattgtgctgtgtagtcaaccctccaaacacagacaaactactactttatgttcattttttacctgaagtctatatttcttaaaataccactgcattagtccattctcacactgctataaagaactacctgagactgggtaatttatgaagaaaagaggttcaattgacttacagttctgtaagctgtataggaagcatggctatggaagcctcaggaaacttacaatcctggcggaaggagaggggaagcaagcaccctcctcacgtggcagagcatgggagagggggaagggggaagggagaagtgctacacacttttaaacaaccaggtctcctgagaactctatcaggagacagcagtagaagactggtgctaaaccatcagaaaccacctccatgatgcaatcacctcccgccaagcccgaccttcaacacgtgcagattaaaattcaatgtgagatttgggtgaagacatagagccaaaccatatcaactactttatttctgttaacaaagttgttcactttttcaaacaatttttagtttctcccttacgtcttagaggaagtgctgtttccttcctgcagaaaatactccctctgtctgcactctacacctgaacctctagattctgaaagactgtaatctatcaatcactagagttgtttctatatatttccctttccatctgtacaaattattgaatgaatgaatgaatgactcttctatgattccattgttggtttttgagatgcatgtcatggttacactctaggtatagattcccacaccttgactttatatcctggttccaatgattaattaactctatgaaaatgaacaagttttctaacttcgcaaggtttcattttccttatctgaaacaggaaataatagtaggattatgtaagttttatggggaatgtgacaattcctgtgaagttcttaacatagtgctgttgtacagcagctacctaaagaatattagcaattattgttttaaattgatattttatttgatttatgaatatgaaatgtgatgatgctctcccccagaatttttaaaacctttttcttcctagtttttagagaaatatctttctccgtagcccctctcaaagatactctttccaagcatttcaatgttctttctctgcacaccaccaacacacaaatgcacaaaaacacacacagagaataatattgtcaacaaacttttctaagtttcttcgttaagtcctttgacattgcctgagacaagaaaacatggagggataatttcatttttttatgtctttctctaactcttgacggtgaacattttgttctttactctttgaaagtttttacatttattaataataaaatgaatgtagcaatatagcttctcatcacagatgctttcattattttaaaatattgtaattatttcttacaatatattagagcttaagttcatctttgacagatgattataacctggtgagtgaaaagcattactaattcaacatatttaagctactgtggaaaattagcaactttgtgaaaatggaaaaactcatttcctaatgcgatttaggcaaggctgcaaggattttcattaaataatataaaacaaattagagggatagaaacaaaattcagaggtagtaaacagaatcacactgagagatgtttcaaacaatattttaactatttaaagactaaaatcttttaactgtattctatattttaaaatcagaaatgtctgttaattctcagctatataatttgatgtagttattattactattataatttgaccaatgtattaagaaaataattaatattaaatagatttttaaagtttaaaataaaagcaattttgaaaagtctagtagcataattcatgtactgagtgtacaatagtttcttcagttttttaattctatgaagtttttttttctatatctacttccaataaatgctgatttgctaatctagaagaacatagaaatgattagtgcaataaatcagattctttacttcagagtaaggaatgctttaaattttaacataatcgttactgaggcaattaagtgtaaagcctttgttttatttaatttgattactgattttttcttgtgactgaaaatcaattttttctctctttctttctttcttttttttttttttttgtttgtttctgtctacagaaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaagtactttattgtcattgacatgtagggtatgtttcaagtcataggatcagaagataaaatgccaagctggcaaggtggctgatgcctataatccaaacactttgggagcccaagataggaggattgccttgaggtcaggggtttgagaccagcctggtcaacatagggagactctatctctataaataataaaaattaagaaaaaatgcctaaatgaaaaatatataaattttatattttaatagtggcctttaaaatctgtgatacagatcaatctatgttgatggtattactttattttactctcggaggtgtaaatttataatcatgtttatttatgcctacctcactatcaaactttcaactgatagattgtgtcaatatgatttaatttaacttttgctttaattaagaagattagtattgtgcctcaggactgatgactctattgacatggagttaagccacatattcattatattctttgaatttttacgtttttttaaatatcaaaaagataactctgaattaaaaatcaattagaattctacacataatttttcatggagataaaaatacctataaagtgtacatatatatatatatatatatatatatatgttttgtgctgtataaacaaaattaaatatgcagtgccttttcaattacattacatggattcttttgataaatttatcagtaagggtatttgtaaataatcgaactcatttttcaataaggaattaaacttttttttttccaatgaagtaatgtattttttttctagccataaaaatctttagttcattcagttaaaaattgatttaaatcaattagaagtagcataatattggccgggtgtggttgctcacgcctgtaatcccagcactttgggaggccaaggcgggcggatcacaaagtcaggagattgagaccatcctggccaaaatggtgaaaccccgtctttactaaaaatacaaaaattaactgggcgtggtggtgtgcacctgtagtcccagatacttgggaggctgaggcaggagaatcgcttgaacctgggaggtggaggttgcagtaagccgagatcgtgccactgcactccagcctgggagatatagcaggactccatctcaaaaaaaaaaaaaaaaaaaaaggtggattatatttttatatatttgcacacagataattttttacatatttatatgtaattattttacaaatgcattatttttacctaattagttagatattaagaattgtgttcttcagataattattatttgcatttgcctaaaactatgtattggaagcatattgccatatagcatttgaagctgtacagtagagcttattaaaattttatgtgacttttggggttctccccacagtaatgagaatttgaagtatgaagttcctaacattttagctccagctttttctaccttctgtgaaaataaaacagccttcacattttttatcatctttagaccaactgcatcttttttatagtgacagacacagccactctagtttatgtgttcagagaaataagtgcaagagtttcagattaagcaattcagtgcctagaaaactcttcagccagcccacaggtcaaacagaaaaataaatactccaaaatatacaaaaagtcttccttaatgtttgcatgtacccttgtttttttttaaattaacaaatttcccaggaggatagaaataaagcctagacgaaagtgtcatgagacaacttcgaggtaactgtgtgggcattagtcaagctgaattaggtctaacagtacttttctggaggtcttagacacagagttttgggttacttcaaatttgtattaggaaatttagttattcctaattttccaagcccacggcttttgaagttagattcaaagcaaatactgaaacatctggtttcctttctagcttaaaaaagtacatttgcaaatagaggcatatggatggatatgcacttatctaacttttcaaaatatttctgtaactcacttgataaaccatcatagacagcatctgtataattatggtaatctgtactgattttacgtgaaagaaattcaagtatgtcatcctatttgagaacataaagtcagctaatgtaccagttttttttttactgctactgcttttatattttgaaatgttactgttatattttgtcatagtttttaagtgaacagataggaaaatgatactatttcagcttcttattccacaatttcaaaacaaattgcctcataaaaaaataagtttaaatcatcatttatgggtgaattaatagatattgcattaagtaataatggtagacaaactgtattaagcaatatataatattagagattcttggtaaagtaataacacaaggataaatattttctggattttctcagaatattttgttcaattttcaatcttaaaataatcttgtttaaaatatttctgaatttgaaaaaataaaactgaaaaatcagattaaaagcaaagtctgaatatggtcaatttaaattttaaattctgaacatccaaaaatcaaatgaatttgtttaattaaaatatactctgacatagtattgaacttttactataaaagaagtttgtgacatgcaaaggcaaataaaatgttcaagtttaaactgtataatttaattgcctttgtaatttaaatggaatcactatctgttagaatttaaaatacatttattttaatgcttcctttagcatttttattttacctatcgaaaaaattatgtcttatgtcatatagaggtcactgatatactcattgacataattgttgatatcataattaatatggtattttaagtatattctttgtctccataacaattatagataaaagaaagatcatgtttcaaaaaattcttaagtatgtattttattttcattgaaggtcacagaaacaaaggcataaaataactaccactttaataacagatttcgtatttattaattattggaatctacataatattaactgttagggaattatgtaatacttaggaataaaaacgctgtatctcaaaactaaattataatgagtgatttaaatattgtcaaaatttctcaacattattaattttacttttgttttggtcattatctgatgtcatttctgttattattattacaattaacctgctatatcttcttagctaccaaaccacacctttgattggttttgtttcctcttttgtttaattattctatcaactgctcactcaattagtcaaatatttgttgagcctctagtaagcactaattagatcccataaaatattaaacatttatttctcatttattcatttatttattcaacaatatctattggctacccgtaagtactaagagttgtgccaaatgcttgaatcccagaatgaacccaactgaatatgttattttcactaataactcacaatcagtgcatatatctggcaatatatatctattacccttgaataaatttataataatacttaaatcatcttaaattctgtaagaatgccatgtattttaaatacgcttttctgaaaaatatcttgtaatatatattttgctggagagaaacatacaactagaaaggaaatatgaggaagattgttatgttgtcattagactactagattagaagcttattgaatatctgctctactatcatattaataatattaattttattacaaattaagatctaataataattgttagaatttatgtttttaaaattggatttaaaagtagattattttgtcaatgccttttaaaaatttcccctcacatgttaagaaaaaatatctaagaatacttaataaatgttttaaatatatttaaccaatactgagaaggagatgtatggtgttggtttttgtctccatatagttttatattttatgatctcctgtaagcagttatattattatttatagcataatgacataatcagcatgcttatctgaattagctctgaatgttaattaagagtaaggattagcctgggatagtgctttctagacatagaatgaccttatcccaaaattctaatggtagctctttgctgacagagaattaggaagaaatcttgtccgggatgggttcatgcttactcagattttcccctaaatgttttctcctcctttttctttctcttttctttcacctaggcatatgattatagagatggcagttagtcatataaaaagtctggttagggcacccaccccttacattaataataaaatatatttttcaccttgcttcaaatatttattttattaaactaaagctactattgatataatagaaaatgtttataaaatgactccattaaaattcccatatatgttaggttttttttcctcttaaccatatatatctccaagaaaattgagctgttctgaaattcattattggtctagggttcttagcagtttgatgtacagagatgaataactgaagaccaaacctaaaagaaaggaataatggtacacacatatccctccaacaggattgatgtaaccttaataattattcactaagtctttaatagtgcatatcttattttgaaattggcatttacaaatacaaataaactttggagaataaattactataccaaattttgcaatatgagtactattacataaaaatgcattaggctatttaaatgaacaaatgattagggtcaaatagaggagaaagtgtaaaggaaggcaaacagtattaagtaacctggacttcttagctagaagagtaaatcaaagaatattcaatgtgttacatgcataacatttttctaagttaaaagaatataggaattttttgtgcatttctgtatataattgcctttaattatttttagagtattagaatattatctatcatattagtgggttaggcagcagggcatggactccccagaatctactcaatggtttattatttacagtgaccaccaacactgtcttaactttatattttggcttaactgtttgatggttgaactgactttagaaaaccatatccaaagtgcttacattaacagctttgatctcagctatggactagcgtgcaatagctttcatatttttgtcacagtgatgggtgacatttaatgtacggtgaaggacaacattgaattattatgcacttaaaaatagataactgttttggtgggatgttcagtgttaaactaatccgctgtcaaaacgactgttgtcacattaaaatgaaatgccaattttgttgtttgtctttgccaccaacttgccagctttttaccaaaaaaaacgatttcaattttaactttccataacataactttagatatattttatttttaatgtcctattttttacttaaataaattgcagaaaagcctatttattattattcttcacacttagcaattttcctaaaatttactgaaaatttagttttaaatacgtgctgttctgctaatatgcctgtcacatattaaagtgattgctaaaattgattaaatattgacaaatatttatctaaattatggacctaaaagtaaacattgatgaaaattagatatattttcaaactgtggattaaaatatttccatagtagatgaggctacttctgcactaaataatatttttaaaattattattttttgttacaatgtacctctttattttagtggttccagtgatgtttatggttgcaagtatatgtggagtcaccaacccagaaaaaattcttagtttgtatctttagtagaaccaaaccaattgaaactaagttgaatcaatgacttcttttcagttgtgataaatatggtattgaggtaattgaggcaacagagctcttgactgaaagtatccatgtaggacaaagaagataatttaatcttcagaggagaaatcaaacatattttccacctctcaatttttaaattatgccagacatttacaggtgtaaaagatttgagaaaaaattgagtaagacaaaggcaatttaaaattaatgtgctttttctgtaattttctgtaatcaaatgctagttggcattttttaaggataaacatgcttatttattttttagaagtatctacatcaatctacaaattatttttttcacataaatataatttattgttaggccaaaattaagtataaacgcaagagcagaaatttgatagcccatctttatttttcaaattctatggataaattattggcctctgtatccttctttgcctccatcaccagaattgagtggaaagactcctggaagcaaaaagacttcctctttctagtcattttaagtgtttccactggaaaaatatcttggccaatgaacttctgagaactatggtcatctgtgatgatttgtttccatttagaagtttcataatgtctagctcagtaaatcacaaaattaattataataagttacagtttatggggtgatatgaagaaactcagagtgctaaaacttgaagtacaacgcttattaaattcttatatttgctaccaaaaaatggcacctctgttcttaatcaattctttatggaacatgtcattgtatttaacacacacacacacacacacacacacacacacacagacacatacacatgcacacacatctgataagagcagcacacgtataaaaaatttttttaaagatttggacaatggagtgtagtgggttctttggcagttactaatgtgtcttttatacatttctcactagctaattcaagctgagaagctaataggacaagaataatactggtttatcttccactttattctttttttctttttcctttcttccttttttttggaccagaataaatatttttttgaggtgtcttttaagaaccaacaggataaggaaaaacaatcattttttaccaagtgatacactttttcttttatgttttgttgtttctagatagcaacattttttcatagcggcagaatactgtgaattgcttgtaagaatacacctctccaggctggtctgtctgtggtaattctcaaaacaaaatttcacttctgttttccatagccactggaaaaatggtgcccttggtctttttggaagctttctcagtcaacctaagaaaggtcttctcaatctgaaacaactattccagcaaaatcagtggctttaaaaaatttcaatttttttaaatgaaatattttaatccacaatgtctagtaaagacaggcgacatcttttatatgaacatatacctttaaaaagtgaagtctgtgcaggaagccagtgacataaagataatgaagaaataaagaattgtttactaggtatttttctttcattctgtatgtcttaatgattaggagtactgtgctcataaaaaggcaattgtcttgagaaatgtagaaaaataggtcagtattttttttctttaatgccaaacatgacacttaaattagttacaattttacttggataaagctgtccttttgctgtaaattatttggggtaagagtcctttcaaatggatggttgtctatgcagtcttgtaccagagtggtgggtcaggtgagggacaattgagagaaaaaagaagaaaactaatacgtattgcatgtcaacagtagccagattatatttgagaactataaagagattcatttattacctttttttaaaattagtaactgtgtgtttttatgatatgatttaaggaataaatacatatatagcagcccccagcccctcaccctcaccacaaatgagattagagatgttttctttttgttgaatgctgttattgtaacactttttaattttaacttattatgaagaagaatgtgacactaaagaaaaaataaatttagaagaaaatggaaaacatattcagaaaagcatttgtatcacttgatttgttttgcctatcatgttaactttaccttctagtttttcttcccaaaatttagaaacttggcagttttttttatttaaagtatgctctattaaatatttttactacatgttagtagtatacggttttacagtaacagataattccttgaaaaaaaaatccttagttagctgtacttaagaagtatgtctttttctttagattgcaaataagaaagcttgaaaactttccaatcaactgggcacctagacaggagacattagcaaccaaatgtgtagatttgctttataaagctagtctctggaaatgctaacactttttccctgaaaattattagctacgtgttataaagctagtctctggaaatgctaacactttttccctgaaaattattagctacgtgtattaaaagaataaaacaacattgtgagtttttctgaagactcaagtggtattagtattgttttttcataattcatggatatgagagaaatatcaatgttaaataataatgtacagacaaaattttagtgataaatcacatctttctttatactaagtaaaattatgcactctatccaaataattaatgagtaggagatatagtgtcatcaaccagtgtaacttcattcattagagcatctcacaacaccttaattgctataattttttacattccattacataattacatcattcaagttaaactgttttcatatcaatcctgttgggtatacatatatagaaagagagaggtttctttttgttgtttttgttttttttttttttaagaaaaaatatcgtggctgtcctaaatagtaatgggaatttcaatatctttggatagaaatatcttggttgatctatttcgtatataaatataattagtaaaacaaatgaccatgcaaactattctattaacttttaatatgtatagtttttctagttagctcttgtgtaataaagctgactatgaaaatataaagttatctctctaagaaacttgttgattttatactcatttttgaaattttgtttggaagcccagaaattcacgtttcattcctaatgacagtaaaccatattaatgaagttattatatgtatttgcatttcaagcctatagttattttttctattttatttaatgagcattgattgaaacagactttcagttttaataccttctaacttatataaaggatgatttttctctttccccgcctggatataacatagtttcctgctattctttataagagatgttaaatcctaaattaattacttttaacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtatttcagtataagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttgtaatcccagcactttgggaggccgaggtgggcagatcacctgaggtcaggagttcaagaccagcctgaccaacatagagaaaccccgtctccactaaaaatataaaattagccgggcgtggtggcacatgcctgtaatcccagctactagggaggctgaggcaggagaatcgcttgaacctgggaggcagaggtagcggtgagccgagatcgtgagccgagatcgcgccattgcactccagcctgggcaacaacaacaactacaaaatatatatttattttgatattttagttgaaaacaaaagtaatacatgatttccaaacatatttcagttgttttaggtagtaaactgtgtatagaatgcatatatataattttaaaatattttattgatttgtttgatacaatagagtgtctattttcaaaagacatttccaatttatttagtggggatgtagaaaacccacaagtcattcagctttgtgaaagatgttataaaaattatttttataggtaaaatttcctgcaaaaaagaaaactttacgtgccttatatcttgatggtagctgtggctatttttgtgtcatccagataattgcatattagttaattcaatttaaatggccagatgattttatcctttccaatgctagcttcaagtccttgttgataacatcatttacttactgagtgtccttgtttttttttttcttaaaaaaagcatagttttattttttattattagaaatctcttgaccttctgacttatctgaggacagtctgcctgaagtctgttaattctggatttactgctattaaaatccttagcaagtttttactgcaagctaaacatttgcttttgacctgtgattaattcaaatgtaaatcactctcatagttcttttaaaataactactttttaagtttggtattttatttgcaaataaatagctatattggtaagaaataattttttacaagacaaacctatgtttttttatgtaatattatatgtgagccattttccttactattctcaatttaaagccactcttaatttgattggacaattgggtgttttagaaaaaaaatgtatattgatagccagtgaatggaactacatgatagccattgtatattaaaaaatagaatccagttttgaatgtctaattatagtttttattttactttgacatttgtaaaattgcctgaattcatggcaaacaatattatgacttttcttcagaaatcttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaattctaaagttgattattttattgtttttagttatccatttaagactaaatcatatttatttttcattaagattatgtattttaaaaaattgaccacgatttaaatttgttatcactaacatattacaaatcagtagaactgatcattgttatcatttcactaagcctttcaaattcatttggatctactaaataatacatttaatagcatattattacaatgttaggtacaaaaatccttctacttcaccatgtacatctggtaactttctggtactaacactaccaattaaataatgtcgagcaattcatgaatcatctataaaattggcttaaaaatttaaatgatatttattgttcagtgatgtgatgatagtttaataattggctatggcagtgaaaagggctttcctttgtagcatttgccaattttcatagtttaaatattcccacaataacaaatatcaaactaccaatgggagggtcaccgaatacagatttgggaaaagagatgcaaaattagttattgcaagccagaatgagcaggccctaggataccactaatatgtaatatgttcaagagaagggaaaaacagtaagctgtaaaagttaatagcaggtagttcgggtggaatgtattgacatacaaatatacacaatgtatgaagaaggatatgtggaagataatgacaaggttgtagagccttgaaagcaaaagtaaaaagttaagttgttattaagataattacaacctcggaaacaattctaaacttaaagtaaatgtcagtttatcctcttgctcatttaaataagtttatacctaaacaattagcataacatttttgagttaactgtatatgaacatatctatggacaagagaaattataccaggaagactttagctatatgatgttttcagggaatgagtcattgtgaatattaatgttttcttaattattgagttttcaatactaaattacaaaaatttaactatttacatggaaatttttttaactacaacatattctttcctgcttataatttttaaccaaaagttcttaaaggaataaaactctttaagataatttagttgcaatattataaacatcaattatttttacctgaaagttcagtaatagcttcagggcctgtattagaagaaataggttccctcgcgggtaataggaaacttcaccatgttgtttgaattaataggggatgattgtgttcatagtctcaaattagacaaaattgaaacagcagctgaaaggtgttatcaaggaacctaacacctctatctacctgctacatcattcttagagacttttatcctcatagttacaagatacccattgaaaggccaggcattttatctgtatcccaggctgggaagaagggagaaaagagaaagagcaacctgcaaaagtcttcacctttttattcagaaaggagatgcttcctctctgtatatcttattaactagaattattttgcttagatcgccctagctgcaagagaggctgcagaaatggctttcttttatctgagcttactgccacttcagttcttttgttagaaaagtgatattattgggtatgttattggcagtggctgcccatagggatttattgaattgtgaagtaatgattcatcactcatgcaattctctcaaaatttttatttcaagtgctcatttctgaaattttctttttccttcattgtcatcagttatcagaatgcctgtctctaagcagtataactgctcccttcttgtttgttattttaaaccacattttctttaaaacaagttaatgaaacgtaaacaacgtatgaatagtaagtgcaagtatttcatgtcttagatttctgttatactttctttctggttctggtttatattgttgaaattcaaatttgccgaactagttttgtgtaagaaacatgaatcattactctaatattttaagtgatgctaccaaaatgtaaatttttaatgttgtagaaaataactctgatttattttgatgtgggatattcaaatacatcaatgtttttcccaacttctctatagccatgaagaagttggagcaaaaaaaaaaataatagttggtaaattgatacccttcataatgcccatataatataaatgcatcatagcatattttaggagagcttttacaaatcatcagatactaagctgtttctaggggaaaatatctctatgatcaaataaggtcaggagaactatgtagtagagttttcttttaggaattcactattaacaaattaaaggctctgaaaattcttgcaataaagaaatctgattaggtttgttgaactagcattgccccaacacttagccatggggccttttttttttctctgttaatctattatctctaattttatgttctctattagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcgtgtcacatctatttaagtgatagtttatgacttcatagaacttgtgtatagataacaatttgaagtttttaaaaaaattactgaaacaacatcattgcttcaatttttaatatcttcttttaagaaagtacatacaataaatgtgtaaatttacatttagttataaaattaaagtcatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatatgattaatgtaaagtccaattttgttagtattattaccttctgtggtaaaggagaaagtatgttagaaaacagttgataatttattttgtgtttattgcaagaatgaaattagttatctattctttataaatgatcagtactcaaggtggattaattatgtagattttaatttcatccacagttgtgaaactatacattttttacgattataatctttttgttggagtcttattagtctagcttatgacaaacaatgtacaagcagaactgaaagaaggtcattgtattttaaatctcatttacatgttagacaagaaatgacaattattaatgttctacttttggaatacaagtatatagtacaaaaagctaaaagagaagtagtgaattcagttcatatgtgagtctagagtgtctaaaacttgactgtagtgatattaaaatggtctgtttagagacaactagcaatttttatcttcatgtctctagtttgctcatcttgtgtaggttggacaggtagcaattttgaatggctcatcttaaaatgaatgcaattatcaaaggattatatggtccatcctgcaaggcattcactcattttaatctttcatttgcagctttctgactccttttatacaatttcatttatagttaatgggaagtgttatagcttagttttagcttactccaaataaaatatgtcgttagacaaaagcttcataaatagcagttattctttctcaaatttgaccaagtgttgtttgtttcttaaagttagtaaagttatattatttatttagtttgtgatcataacacacaaaacagcatgtatccaaaacattaaactgattatcataatttatagctagattgagattatataaattcatattccatcctaaacattaatgcacttgtttttttatttagtgatcttttcaccacctaaaatttattactactacatctatcaatcatctacctacctatttctattcatccatgcatcaatttatcaataagtattagcatataaatcagtgtgcaaaatttattttttaatgtctcgctcattcataatttctaatatgtatatatttggaataacctgccagtcactatacctactctttcagaaataaaaaatggaatttttatttattgtttgattaaatggaatagtactacatggggaaatgatgactttatgaataaatattctggataataaaagtagtttttactagagcaactaaagaaaatatgctgtagtttaatacagcaactaaaaatagtttgattttcttaactcaaatattaaagtgcgtttagatattttattgtataataaatcatatacaaaatattgtttcaaaaattccactcattgagagaaattaatgattaatgttctacttcttttggaatacatgtaccatagtacaaaaagctagaaaataactagtgaattccgctcctatgtgagcctagaatattgaaagcttgactgtagtgatattaaaattgcctgtctagagacaattagcaatttctcttttcatttttgacccagggaatttgaaggacttttgtgtgaaagaatttcctgcagattattaaactttcttgaatcataactataaaacaagatctgtgtgtgtgtgtgtgtgtttgtgtgtgtttaaaccttgggataaagactgtaaactccagagacttaaaaccatttactcccaaatttttgagtatgctctcactaagaagtgtggagaaatgcaaacgtaatgcatgttctgtctaagtggagggatttaaaatttattattgggaaaggacaaatgtacatgggaaggcaccagatgctattcaattagtccacctgaagatagcactgtaaaaggcataaaaagcaggctcaagaagtagttaataagaatggatggcatttcagtgttgagaattgcctgcagaggatgtaatcctaatggtatatttgtctataatgtatctaaaaacaatacaccggagtacaacaagtagcaattttatttgtagtttctgcctctattaaccacctgttgtctacctgagatttgatttacttgacctcataaatactggtccgcactagagtgtggtagcacagcaaagaacaacaaattgttgattgctatttttcctcatatgttattttacaaacttatcacttgttgcacagttgtgaactttgtacaaaggcaagaagcattttgaataacatggtaaaatgactacaatcataaagattttgctaacagtttctcagagatttgcagtataaagctaatgaaactgctgaatgtaattctgaaaatcttctggatatgatattttgaaagcagaggtataaagaagtgtatcaactgtacaacatgttaaggaatatatattagatatataacatttaaataagacattgggacataggtattttattttctaatacaaagtcttaagttcttgaaaaacttttaaatagaccaaattaggttagtggaataacaagaatagtttataaacatcatctgaatgctttaagacatttagggaaacttaattgtgtgattaaaaacgataaaagtgcatacagcatttcaaataaacctatggagttctaggcccctgtctgatttaaaagaaaaaaaaaagctgagcatatcattattggaacctcatgcttgaatgaagaagctgaaacttaaagaaataagatgacctaacaagaatccatatttaatcatagaactggagccagattggtgaccgcctgcagtgcaccacagtacgaaagcaacatttagccacccagtgacagaactttactttcacaactgtaagtaaagttcaaagtttaagtcttgagcatgcaggactttaatactcgtagctaacattgggttttgcggtttttaagaggaatctgtttcttcataatatttaatgttactttaggtattaggttattcttttttatctttttttctttcttcttttagaagatcttaaaatggtttcaatccataaaatatgactacgacataaactttagagttctatcagctatgtagtgtgtagcaatatgctacattttagtttttcacttatttcctcatttatcctttaagacattaagtagacactaatctttgtgcattcactcactgtttttcagggtctttggaattttcttcctcctctccccttttatcttcctcctccttcttcattttctgtaagaatgaagagcacatttctgaatttcccctttctttctcttcctactgtttcagtagttactgataggagcttttcagcatgatttggccactgttttttcagtcctacatcattctgtccgagctgtcatttagtaaagattaaatttagaagaaaattttatttattatattgtatttggttgttttaaaatataaataaaaatttgaagctggactagatttaataagaaattgttgagtcattttattatgtgcagctagtaagttggtgcaaaaataattacggttttgccaaaagtacattaaaattaatggcaaaaaccacaattattttgcaccagcctaatatttttacatactagtatttattgaactttttccttattatccttcatgcagcttagataatatatgaatgtttatatctaagctaacttgaaggaggaaagatttttgttgtagtcaatttacctattccttgattattatctttttagtacattacagataaatatatttacctataatgctatatttatataaaaattttaggacctataagttaatgttaccataaaaaagatccagggaagaggaagagagtaaatagatattagaacttacaagaaatagtaaataattatataaaataatgtaggctaatttattaaacttgctgtctttcaattaataaatttgcaaagtgtaatatgtttaacaaatgagtgcatacattcaagtaaaaatatttctatgaaaagacagataagataggaaggataaaaatggagatataatgttcatagcacattcagacaaactaaggcaaatgaaatatcaatcatattgagaacatcataaaattcttttggaatgaaaaggtgtttttatgcccctcccttgttttatacataagataactgaggcactgagtggttgaaagacatactagagatcacacagtcaaaggtgcaagaggactggaaatagggctctcaactagtatagaaattaaaggattctcttcaaaaaaataattttaaacagtgtttgaaattattagtaaaacccaacttcaaagtaaaaaacacaaaggttattctgtaacttttattaaggtactaccagctgttacacagggataaaatattattaataaaaataattgacctcataatcagtataaaagagattttgatggtaaatatttggacagattttactgaagtacaccaaataagaaaaaaatatataaacatgattattgttataatgtcctataaatctctataaataggaacaggaaggaataatttaaatgcctgcaatgagggtttcagagtgagtaaaaaatttttggatgctgaaggaagatagggttttctttttcttttttttttttttaaagatcatttgggatttagggaaaaaagtgtctactgctataagaagttggaacagttctatttgtttagtgaagtagatagtcaagcttgagatgaaaaaatattttgagaaattaaataactgatagctcaaagaaatgagtagtcacagatggacttcttggccttctttcgtgagcacatttcctgttttattggctttggataagtaaagctcctcaaatgaataaaaaatgaagaagaaaaaagcatccttgggaaatgcataaaatatgttcattgcctttttgaaaaaaataatgtgtgtatgtgtgtaagtgtgtttctgtatatctgtgtacatatacacacatacagatatatatgcattgtgtaatacagaacacaatgaatagatatatatagattaattctcattaaccagaattcataaacaattctcaaaggcattaagaaataatgcaatttttaacatctacatgtagagaataaaaaattttaattatgtaaaataatataatgcagcactatcagaaataaaaatctgataaaatcagaaatgttatgagttttgagaacagataaactgatagaagtgttgtataaaatctctagtaattgttttaaaaataatgtattattaaaactcttagtatatgtagttatagaatttgagtattaaacagaatcacttaaattattttaaatatctttataaagaatcagaaacatttaataaatattggcagtggtatatgtttctaaattaaaaatagaatgtctgcttataatcaaatgcataaacatgctgtatatgctaaacagtttagtcagtttttgcactaaaaactattatctgcaagttaaaatattataattaaacagtcatttttatgactatctagcaatatggcccaagtgactgggggattttgtttggtttttttaaatcttgattttaaatttgagtcaattgttactaatttactattattatactctctaatgtttgctttggccataagtaataacataagaaaaaatatattcttccattcttaaagtgaaaggagatagaagccaaatagttaaatatgaatgtcatcagttcaaatcaagtgttagcaatgtataattttgtgaggtttttcattggtaaatacatagtacttatttataaggaaagaacatagacctaatcatattgtatatttgagcatgttgtacatgtgaatcatatgactttcaggtgtattctctgttttttattttatacaaataaaataatagatctgccttttaaataatagatcttaccatttatcttgaaattgaaacaaagaagatcattagagagctacagaatgccatagaaattacaggaaaagaattaggtgactataactaaagggggtcacagtaaaataataccaacatacaccacacacacacacacacacacacacatacacaagcattggctaataatttttcaggtatctttatctaagataaataatttttcaagtatctttatctaagataatttttgttttacccttcagtggatttacttcacatatatgtatagtggccccttaaagagaggcagccaaacaaacactgcatttgtattattgctttcttatttctaccatataaaatgtaagggctgttttgtcttctgttggggatacagtaaacaagggagaaatgagctggtaaggagaggataaactacatctggaaaagtcagagctagtttgagatgggtaagcatgtaaagagaggaagaaagaaggaataatgaatgccaatcaggaagttggggctatagccaagaattttaactgtagcctccccagcaatatgaggtgcctgtcacaattacaaaactgtttgcctcattacatgaatcagtcaaatgatcagaccaaattggtattacatttcatcaatagattcttgatttttactgaatcaagaatattattatttatagttttataaaattcaggaaaatatgtatccactcttgtaaatgtatttgggtagctttattgtatctgctactggttcagaatgttttattttgggagatgctgacttaaagattatcctagacagcctttaaacttaaaggtaatcattatttgtaacactttgatttatttttaatcaactattttaacattgccgttcctttacctcatattgaatcttaacttactggaagcccctattctcaaaaatttgcctttaatactattcaaataatggtcccatccaaagttctcacaaaacattgtttgttttctacgtaaaacaacattcaaagagtaaaaataacttgagaacatttagtctaatatgatcatttttcagggaggaaaagtgaggtgaagtgactcatcttattacacaataatacacacacataatttaagtatgtaagttgaaaatcatgagctttaattgcattattataataaaggttttacaaaatcctgtcctgcttaagtaattacccttgtaatgtctacccttgtgagtgaatagataataagtaaggatttattttcaaaaagataataaacttgtgggttatcaattctagaaagaagctttagtgattaccaggggcaacgcacacacacacacacacacacacacacacacacagacacaaacacacacacacaaacacacacacagagaccgagagagagaaatcagcactatagacaagactatataatctgttgtatcaagacaactatcaattatattttttattgggtatacggctaacttgcacagacatcctaaaacattatttaaaaaaatggttggcaaatagaacaagtaatcagaggaagagcagaacctttaaaaaactcgttttcaaggcagcaaaaaactctaacagactctcttaagaagtgttttagctcccactacttagcattaataagtgtgaaagggattcccagtctcaggcctacatccctgtcagctcttagtatttacgtgcagctccttaattcatgctcaaagattatgttatcaacaatgattaccagtggtgggaaagccgggcttgaaaaggctgaataatggctaagactcgcttctcttcgtgcacatttaaaagcagtgctttcattgatagccaaaatcctgctaacaggggtgggtattattgtgcctactcctcagtttcatgaagagatctgttgtttcttagaatttccacgccacctcatctagtttcatgttgtttttccttgtgtcattaaaaaataccttgttcccactttttctgagtgctgtttccactgaggctggccatccagcagtggcctgaggttcttaatatttctctttattttttaaaggaaatgcatcttatgaggtagtgtttacaaaccagtcatattttagatcccaccactcattctgttgaagaaacttgcacttaagatgagagtaatgcaaagctcatttaaaaattctttatctttataggttaataatcattctgatattttgtttatttttcagaaaaatatgttactcgataaaacacagaaatagtatgattctggatatattttatttttgaatttaaagcagtaagattgattccatcagtagtttaaatacaaaataaatctgctcaagaagtagatcacaaaaaagacaggtagactgggtaaacaaggaattcatacaaatactctttgtccaaagtgtccaaaatttactagctatcaatattactacattgctctcgcttaataaaatacacacggaagaacagatacattttagtgattgttttattaactctataatacctctattatgcccaaggaactcctgtgtgcaatttattgaaaagcattagtatgataattattcatggaaaaagcagctctgctctgaatcttctacatccactggcatctacattctacataacactgaacaaagtgctaaagaatttcatttttctgtgtatatggacccaatgaaacaatagtatttttgagcacttattctattttcagtattgttctaatgctgtaagagatgtaaaattaaaatgacatacttcattcatttaatctattagtaagtgaattaaggctttaacatatgaaaatgatatcaaatgggcaataatgaagtgagcattttaggtggaggaggctaaaataaatatggagtagcatatttacctttcaaggagtgtatcatccaataagtgaattatgctttaaaatataagtagaatattaatgagctgtaataaaggaacatttttcctgggaggaagaacattaacaaagtaaagagatcttaatatgaatgctatgtaagatgttatatgagtgtcatgtatgagatatttttgatctatttagataaaccataagactcttgttagagcatagtagaaaaaatgatatgactcagctttctaaagccttgaatattgggcagaagaggttagagtttataaaaaagaaatattggtttcttgcagattcttgatcaatgaataaaaagtattaaagtttgagaagatttacttaatagtcataaatagaaaagacaaaagagatataggtgagagaatcaaaagatagggagatgtgttggtttggaggtaattagagcccaccaaaaattgtagtaataaggggagtgtgaaataaaaatggaaaggcaaattcaggaattattttgaaaaaaataggcaataaactttggtgatgtactagatgtggatatttaagaaaaagatagatgattttaagaattctaatctggattgtgggacaatgcttggattacctgccacattggttgaatatagacaggttgtcagtttggtatggagagcatgatcaatttgatattggtcatgctgagtatgaagtatagcattacccccagttacatctatctgtggtcagatgtaatatggaatgggttgagcactggtgagataccagtgaattcagctatatagatattctagctaatccaaaatcggcaaggggctattccaagaaaagagcaaataggctagctgtatattagtatggatgataatgactatattaagaatctgtcgacattatagtccttgcaatgtgggagttactttggtttggagtgtgagtcgtattactgatcctgacaatgtgttgcccccccaccacacccaagtgttactctttctaattggaaaccttttggcatagtgctaactagctaatatgctgcattcacttttatttactcttatcaaatgggattatgagtgtatgatatcaggtttcttgagctttcagttatattcaattgaaccaaatatatttacattcagttgtgtttattttatttaaaaccatcttcctaaattgtaaactgatatattatttcttagcttacataaaagtgttttctaaatgttttattactttcattcctttcttaaccatagtttaacttcatccaacttcaaaacatcaccatatcattttacattatgaagccttttacatctaagtatagaaaacgcattatagccttaactaacatcctgctcattaatgatttggaaggtaactgaaattaattatagctaggaaaatcttttccttagaaactaactctaaaagtacttaaatatgtacaattaaagaaaaaatgatacgggctgtgtgactcaaaactaatgcacacacaattactttttaagtaatatggataatttattgaacaataaaaatattttgggatatatgttatttataactaacaacagaagatgtataatagcaactgataacagaataacaaccattcttattgaaagaaattgccatgcaggttacataaactacgtatttggaatgatgactaaaaattttcaggctaagaagattgtttattattcattaagaaagtaaaaaattaaaaaaacaagcaaacaaataataaaacctaaaagtgaagtggtacttgctgaatataagaagatcacacagtttcacaggataatttggtatgtttgcagagcatgccactgaaaagaaacctttattttatttactatggaataaaacagtattttaggaaattatttcttagacttgtaataacattataaaagataactgcacagacgaaacttcagggtggcaaggatatttttacagaagattcttgtagtgaatccttgagtttcatatggatattataaaagaatgtaatggcagtgagtttgatatggtgccttccccaaagttacatgacattatgtttgataattgtttatcgtagacacatacaatgttttaagcttacttcttaatattttattttctgaaatcaatgtcaattaaaaattaatggttttgaaaaataagcaatctatcccggaaggtattttttccccctctcttcaaatatgtttagttaaattcctttaatttgatttatttcatttgagagatactgtgatctttcagaaaaattgctggggctcttgcttttagtatttcttcatggatttaaagagataactttttctaacagtgtaaaaaatagcaatattctattccatgtgaaaaataattcaaattcaggtggcaatgttaaaatatagtacaaacataatactgtaaagtttaggcttcaggtaaatttgaatgttccttaaggatttcatatctatgcatatattatttaattttaacatttgaaatatttatattattaggcttgatatggcagtaaataaaaaataacatttattccataatatttttaatagaaattagttaatacacttattaactaaagcatgatcttttcttgagcatttgtgacgttttttgtattctgataatatcacagactttatgaccaaatcttaattattgaatgctctcagtgtgcatgatttggttctacatagtgaaggatataaatatgttaaaaagtgatgaagcaggaagtcttctattcgagtgaaaattaaggaattactcattgattggaaagtaggaaaaactagaaatagtattcctctataattaggaataaattagatcataggaattcccttttcttgttttatgggaaatgataaagattgaaatgctgactggaatggattgcaataagagagtaggaacattttcacaggcgatctccattacagacctgactcaaaccttctgtgcacttcagagatacctgatttatacaaaactgaatttttatactaatgtaatagttttcttaagtcatttgttacagttcagaatgagacaatatagctaagtttgtttcataattggcaagtgtgacacaaacatcaggtgatgttattattcattatatgtaacattttcaatagtttattatttaaatttgccatctctgtaatgcctcaccttattctttcatggcttgttttaaacaattttagtcgcaggcaagtctgctttacaaaggcttgagatgttcccattttatgcctgatcccactacagatgtcatgaaaatggcataatttcagcagattgtacttaacagataggtggtaaggttgtctattatctgataagcctgtagagacctcatttcctttcttcctgacatttaatctaattttctgccaagtatgatagttgttataactggcccttctcaggccatttatgggttaaactaatagtaatttcataccctagaagtagagttaccctagcaactctcagtccatctagatccaatttctaaaaatactctctcatttctggctattttcttttgtactggagacacaactatgaagtccatttccacgttctgcttctcaagaaaatgccaaacacaccagtggatccatgctcacttgtgttggcaccaaactggcctgatcacctatgttgaaaaagcacatggctcatttaaataatgctgaaaagttgagcatagctgaagtgtaggatgattttaaaaaaatccagagttgagcctgaaaacatggcttatagtcattctgtgaaagtttttaacgtatatgggtttttagtgtagcaattacctgttttccatttctctcctaaataaccaagttagcattaccttgtcacttgcctttttttttttaagtttggatgatgtaacttctcttattaagaaggactactgtattttcttttgagaattttatatttttattcaacaaagtgtaccactccttagcaaatagtaatcatccttcaaaatattcttttttccccacaaatacagaagtaacaattgaaaatttgaatatcaaattttgaatttttaaattactttggaaattaaagtaaaaagtagtaagagatcacgtcttcacattattagtttaactatatgcccatgaaaagaaaaacaaagtcacagtaaatatgaaaatagtatgtaatgaaaaaaaaaactttgtattcctcgtactagaatgtttgtttatacttgattttgaaaatgattgtgtctattttgtttaagacaaattaatgtgaaaagctatttattttccctattccaatccatttactcccatctataaaatgaggtggggaattaatatgtcaacaaagcaattaagtagaacaaaaaaaccagaatattaccgttaactgctgttaaatttttaaacaagatttgctttgaatttttcataacacgtgaaagttgaggattgttatgtaataatgatgatgatgaaaaaataaacacatattgaatttaaattctgacatataaataggacacattctagaaaggccatttcagcttaaggaaaaaaagtgttcaaatgtgtaaaatatatcactaattggcttaaaattatatatgttataaaaatcatttttgtactcttcattagttgtaatgtagtttgcctgtgatatgacaaagtgttcaaattaatgttgaattagcttttttttcaaaaaatggtaatgtattccctcaatgagtagtagattattttatatattttctaaattatttctttgctctaaaggtctagagtaagaaatctttaaacaaggattatatactttcagctaacatttatgtagcaatatgtagtttgaaaacggctttgcacatattatctctcatgctgagttttcccgcctcctctttagaaataaatattcagctcagagagatttagtgatctgtcaccacatacaaagtatgtatttggctggaattcaaaccttccagtctcaaaacttgtagtcattctattatgcctcttttaggcactgaagtaatgcaagtgctaataataatgaggaggaggagaatgatttttaaaagtccatctctcaaaggcctcatgaaactctggaaatacaaaattgatacatgaaatcacattagtacagcaaaagacagtaggtgataaatagatatttgaaacagatcaacttttgggcaaaagcaaacactatggaatttcagaaaggagtagcatagaagccagttgggtgaattaactgaagaggaagaggacttttcacttaatagaaacagcataaacaaaggcataatgagacaatgggccagtctacataatagtttgaataaagttaaaaatattgagtcatattatattgagccttgaaattcagagacagagaaagttaaacctaataattcagtagttaatagatattgattctacacaaggggagtttcatgatgcataacttaatatgaggatagttttacaagacaaaaatggagaaaaggagaatcaagtagagacagttttagaaagtccgtgattaagaatggaaacaaaagtgcaatgaagtcggtaagatgaatcaaagatacatttttaaaaagttgacatgtcttaagcatagtttgtatttaagtaaaaatagtaaaagaagatacactttaagtctcaagagctcagagaagtgacacatcaatttagaaaaggagaaattgggaaacagagataatatgggggaagttatttggttcaattttaaacattttaagcatgaggtaatggtgagctacctaggtaggaagttacagagatggatggaaatccattgagggagaatttatggctgtaaattaagagagttttgtaatcatcagtatagaagttaaagtcatgagtgtgttaagtgattaaggaagaaggaaagttttgagagctgaaacagagccatgacagattatctgttagtggggcagagagtgagaaacaagggtgcatgtcagaagttcaaagggaaggcatcattcaataataatggtattagaagttcaaaaatggttaaaaagtagatttgaggaacaagacaatggatttaaaagcaagattttaaaacaatggaagtttaggattaaggagaaattaggtgtaaagatataggagaataatcattttagatgtttggccagaatttgaaaaagaaagagagaagtaaaaggaacatacaaataattcaaatatgtttcaaatgctcacttttttaaaaaccttgtgctaaaaatttgaggagatgcaaagataaataaagaactgtattgggatgtattcaattacaatataatggaaaagggaaaagatgtgcattaatttatagtgaagaaaccaggctgtgataagtatgacttgaccctcttcattttataaatatggagaaaagaaagatatacttgggttacacaagtagtggttaagcgtctctaatgaagacagcccaaaataaaatagcttgaattagtggacatttatttctctctcatccccaatcgagagaacagtccagctctggtgggacagctctgttttcctcagcaaggggcttctaatacttctctatttagcaccatttcctaaaatgaggaagattccagggcaaatgtctttaatgagaattttcagaaagttgtgcatattgcttctaatcgtatgtcagtggctcaaattgggttgaataacaagagcagatgagaagtacagttttagctgggcatcaatgttactactaaaacccaaggaggaaaacaaatactgagcgatagtcatcagtctctattatagatatcctccatgaagagagaatgaggaaagttactgaatggtagtactgggtagtattgaaggatgggtgtaggatttgaatatctatggagtgaagagtagggaattacagggtaaatgacaatatgagcaaagaaatgaataagaataaatacagggctttttttttttggaaaggggggtcagagatcacatttgctaagaaaagtggatcataatcttgaaatgtttttgaaggaaagtgtgaagaatcttgaattccatgtttaaagtctggatattttatatatggacaatggacacaattaaagatttttaaaatagagatgtgatattatgggaattattccacattaaaatcaactgggaagcggtatatagagattagaaatttgaataaaaagtggaaagtccagttaggagactactgctatggatatgacagcctgaactagtatagtgccaatgggaataaacagaaaatgggaagggcaagaaatgaaaaagacattctagaagtttaccgacataatttgacaactgctggagttttgggttatgaggcaaagaaatataaagaatggaagttgattcaaaggatattaagcctaagtgatttaagggctagtggcagggccactgcaattgttcatttaaggatgctggcaggtgatggtattaacagagataagaaatgtaataaaagaaaaattagtaaaaattgtgaattaatataggacactgtggtattggagagtctactgtcaggacagtggaaattcactttaagtcaagggagtgaataggatttaatatatatatttggggaaacaaataattgtatgagcagaaaaatattaatttggaggccaattgatttaaattatgatttaaatttaaaaagtgaatccgaaagagttggaagatgaggacagatactgaagcaagatctggaaacagggaagatagaattcagtgggacagtcaatcttagaggggtgagatgatttagcttaaaaaaataaataatggagctagaataagagttgtgttcacgttaatgtgagagagataaggtagaccacagacaaagcaatgcaaggccagtgagtaagagtgtgtgtgtgttgggagatattgcttgaaagtgggaatcggagataaaaagaattgacttacctttcctcactattagaggaatggtaatgaatcaaattgagaaagaggaaaagcttcccaagtattgccataaagagcaaattggaaattcatattggagaccatttttcttagcctgtatttgtatcttttggaagctttatccttttggatatcttcagtttaagaaaaaaagcagagaatgtgaggtaaaacatgtacattattttaatttaaatatcaatttaccaaacatttatttttttctcttttgaataaattatacaagagacttccttgaaaccagtgtcagtgttcccagattcttccttcctacctttctccatttccttccttccttccttccttccttccttccttccttccttccttccttccttccttccttccctcccttcctccctcactccttccttccattctttccttcctcttcagattatatagtctgagaaaatagaaaataaatttttcaaatgtatatgtataaatttggatatctccccaaccctacaaccacgtctcattcctctcatttcccatggaatcccttgaaacatctatataatacttcagggcttaaggaactctatgaaaaaactagtgatctcagtcaaacaaattacacagtctcactatctttagctatgtttctaggagttgtcatatgggaaaactaaatctagcttttatagaccagtttcatgttaatagctaatatacttttaagagtaggaaaaatatgttttaattatcaagaaattaaaattggaggttgaataactatagttgaagtcatagcatctaataatatttacttgctattattgtgtcaaagtattgaatatttgccacctgctggcactacattaacccatacaatcctttagaatacgcttatgggttaggtcttcctatttttctcatgctttgggcaggggaactaatggcatatggctgtgagggatggagatgggtgctctagcagcagagcccgttcatgatctaaccactaaatcacattgtctctcatgagcaatcaatgttttagatagttaatttaaagcggtaatattttttaaagaacacattcttgtataaagactgatggccaacattctgttacttggaaatactttaaaaaacgtgtataaactattctcattagcatgaaagtaataagggaatttaaatgaaaataaaatgtctaaaaccaaagctagttctatttcagtcagacacaacaaatcaacttactcttcaatcaacctttctgtttagtgtgtcagtttaacttagagaaccaaacaaaacacttttttgtttgtcaaggataggctattaaaacaagggtgttctaaaattgcattagaaagatgaaaatgatttgtttaatcttctgaattttcatatgtcaggaacattattgtgaagaaaattgagctctctgaagtgacggatacattattcaaataactttgattggatgtaagattttttttaatgctttcacaaagcggacatattctaatttggtttataaaagagtggctttaaaatttgaaatactgggaaaaatatttttttagttcaataattagacaaagcatatttaattgtgggtgtaatgtttatggataattccattaattgataaatatatctggattataattagcataaattatttgcaccttaataagtcctcagtttgaactacattagagatgttaagatttctaaagtcatctacaactggccttaaaaattagatttgattttttaaatcttaaaatagtggttcagataagttatagatttgaaacaaaataataaatggaaaacagtgagcctcagtatgaattcctgcttctaaaactgctttgatggctcggcgcggtggctcacgcctgtaatcctagcactttgggaggcccaggcaggcggattgtctgagctcaggagtttgagaccagcctgggcaacacagtgaaaccctgtctctattaaaatgcaaaaaattagctgggtgtggtggcatgcacctgtagtcacagctactccggaggctgaggcaggagaatcgcttgaacccaggaggcggaggttgcagtgagccgagattgtgccgctgcactcactccagcctgggggacaaagggagattctgtctccaaaaaaaaaaaaaaaaaaaaaaccacaacgctttgatactttgatatcatgctgattggcatgttctctgaaacctataataatgtcagaagcgtgtattagaatgcagtagattcttatttttttgtttctttagagttgagattttacacataaatatgtaaattcatagaatcattttgttagatacataattctgcattgattattttaatctctgttactttggtggtttctattatagcatgcaaaattcttatgatgattttatatttttttctgtctttaaaatactctacggtctttaaaaaatgtttcacaactaagtttgttttctactttaatgactttctagctttcaaatttttataaatcctgtacatacaatgcctaagtcttaaaaaatgttattggtttactgatatacagattttcctctaacaaataatgtatagtaagaaaatgcaatttcttactgtggaaattagctgataaggacagggatctttaaaatcgaacacttgcaggcacgtatatgaaatcttgtaaaaatgtctgtttctgctttctacttaaacttatctgtctttttgtttcttttgcagcaaaaaatgctggatagaatttcttcccactgcaatttaaatgtattcttttttctgtcaattaccacaggtttagtccttatgagtggtataatccacacccttgcaaccctgactcagacgtggtggaaaacaattttaccttgctaaatagtttctggtttggagttggagctctcatgcagcaaggtatacgattcagcctgctatttcctttgggcaccatgtcccactctttgctgggggtgacagctcttgctggcacaagtcgcttgcatgggtgcctctgtgcatgtaaccataatccagcttttccatcgacctaatgcatttaggccttctcaaatcccattcaagagagattctgagaaaataattagcttttgcaaatccacatagagtatactcatctatttttttccttaacctacagtagatacattatttcatagataaccaagctaacctgatcattagccagaagctgcatttaaactactacaaagattacatctccttgagacaagaatacagtgttatgctcctgtttcttgtctcattttgatgtaaaatcttctctttcatattaattcttggtgattagatgcatttgtattgcatgattagtaaatttactgcctataaatttgaagagttaaaatattaaaacatgaactttttgagtaaaatattagctgcatttgatagcatataagaatataaaatattgcatgctcggaagtgcatgcaaaaatactttttcgtaattatttaaactttataatatacatgttaaaattaaggctatatcttagaaaatgagataatacatgtactaatacgtcttaatggtttatatgtaactatgaatctactattttagtctcagtttttttcaagcagaattttaatatttgatgctatggtttcttttattaatcttttcacatttaaataaagtttaacaaattgctatgctagacctattactcaaaataaaatattttattagtcaaggtctaagactagttttgccaatttaaaatgtaacattttaaagttttaaaattagtaaataaagcaaaaaaatcccaaatttgaaaaactgacagtaaaggaagaaaaaaaaacatatttcttcataagagttatcatacctatcataaggtttgattttaagtttttgttgtgtatttaatatccactttgaagaaattcatttagtgattgcattacagatctgaagaagtggaaatttatgttgttataaaatgttgtttctaaaaaaggcatcgtgctattgcatgtttaattttatgcagaaatgcattaattcattactgtttcatttataaactatttcctaaagtgaaaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagttatatttttcctttcctacattttcttacattttgggtccaagggttttttttttttttttttttttttcccttaggcttactctacccttagaagacattattgtagttctttcaaaataacagaagtgaatgaaaaagcccgtcatatggcacaaggttattttataagtagtgttgagtaatacaagtcacccaggcaaaactgctagtcgtctgttaataattagtagtctggagggagttatcctcataataaacatctgaccatagcaagactttcgttttaaaagtttcatatctctttgacaaagaaaacattctttttttctacttatattttaaaaaaatatttggaggtctttgagaatttgtatgctcataggacaaacttgctattagtagtatttaggaattagaggtaaaactctatgttattatctctgaagataatgacaagcaattcaagcaatgaaaaattcaaatatacatttgcttcgccacataactacgtcactgctggtggatacatgaaagaggaacccatactattctggctgatgcccagcttcccaggaattagtgggatatagtgctggacatgacgttaccttgagtacatgacagtcagcccctaaccaggctctgattcacaagactaggaggtactcgctttaagtccttgggtaagatatgaacttgtggtaattgggccatttatgtcaaatgtctccactattcttttctttcccagtcttgtttgactttattggtgttgttgtttaaacaaaacaaaacaaaacacaaaaaaagcaaaataggcagccaatgctgctcatcatcttgggagtatttagtgtttcagtgtccgagtgtgtgtctgacagggcctaggagcaactacatcagaaaggtacttttctgtttttttttccttacagagctgtaggcagaatctggagctggagttggctgtcatgtccaagtttgtctgcttttaaaattttgtttgtttgtttgaaattgcaatggtaagatgaactgcagtataagatgggctgttttgatatagtgcagtcataataccacttatttttcaagcttcacatgaataatttgttttattttttattccatctaaagatgtgttaccttactgcatcagagattatactaaagatatgactgtaagtccgtctttgcttcattccattttactcaaacacaaataaaattaagtacttttagtctatgctttcttgatagattcaaaatgattaaaagtgaacagtaatatatgcatatctacaaatttagtataccttacttataaaaaaatcacacatactgatatatgtttatttaagcattaagaatataaacaatgtggtaagctgtaattaaaatttaaataacagaccaaattttaaattggtaggattttgttttatagtctaaatgaattaaaattaataatagtcaaaagtaaaatataattctcagatcccattcttttattaagatcatgagcaggcaactccagccgtacattctgatatagttataaaagatttatatatgtataaaaataaatgtgacaatttagctatatattcttattctaatttttttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaagggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacatgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaaggtaagttctgctggttacctaaaatttacaaattaaaatgatagagcgcaaacttctctcgattcacaaatgtaagagtgtaacaacgccattatttgtgcacaattcttaataatagcatatacctcaaggggtggagaggtgtacaactgaacgtatgctcatcaagaccaatcattttaatctctgaaaatgctaaggaggttttgctttacaatattttgttcctgttttgaggaaaatcagcccaagggtaacattttttcccagtaagcttttctttttgaataaaacaaaatgtattttttgaaactgtaatagtaggatgttcagattctacaaaactttgctattccagaagaatagaataattactcggaaaaatgtttcccatacgtacatttacttttgttgaaatgaggcaagatttaagggctgaaaatacagagacagtccttattatctatacgttcaccaaggtaatagtctgggagacacagagttgaaaggggctgtcccattgaactcacagtggtttccagagagacagccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacagaaacacaactggcagttcaaatgtacagtggaaatagtatttttttttaaaaaaatgattaattcaagctataaaataaattatttcatgaagcattcatcaggtttctatcgagtgccagaagttacacgacacattgagtattctaattctcactatcgaggagattatggtttagttggagacagaataataaacttaaaacatcactgaatttggttttatgtgacttaagtcagtattttgtcaaattatgcaactttgtaaaaatttttataaaattaactttaaaataaatttctggaggacatccaattcccccaaaaataagataaattagatttagtcaaatatttaaaatttaattattttcaaagtgaatttctcatatgactagattaagtattggatatggatttcacatttacttggaaaatcactgttatttaatcaaatttattgaataatcaaatataagcaaaacaatacgttcagtatggtcctatttgactatattaattgcgatggatcagtttttcttaattgaatattgagaatttataagatttcctttcttatcaaacgtgttaatatttttgtgtttttataaagaaataagctgctaggccaggcacgttggctcgtgcctgtaatctcagcactctgggaggccaaggtgggtggatcacttgatcccaggaggttgagaccagcctccataacatggcaaaattctgtctctacaaacagcccaaaaattagtgtggtgtggtggcatgcacctgtattcccagctacttgggaggctgaggctggagaatcacttgagccggggaggcagaggttgtagtgagctaagatggcgacatagcactccagcttgggcaactggagtgcaatcctgtctcaaaaaaaaaaaataaaataaaataaaataaataagtcgctgaaattgctaaacgtgcgttgttagtgtcaacaacttgaaggaagtgaatgcgtgatgcatttaatttattccaatatccaagtgacttttgaattgaatttgtaaaatataataatacaacctattgtacctaacacaaaaatttgacaccagaagtgtttatttctggttcataaacatttccgttttaattttattttttccagaagactcaaatattttgttttaaagttcaaatatactagtagcaaagttcatttttgaaaaatcagttaccaaacatatgtattttttctttataaaatttttatttttaagcttattttcttaattctttgtcttttcattctttcgttctttttttaatagttcaattgctttctgctatgcaatttttgcctactttcacttttccttgctactgacttttcttcttactcttttttatctcttgtttttctctcaaacacgagtgcctctagcaccttgagaaagtcgacacgacacagctttctatttccaacagcacatatattatttctttagaattgtatttggaatgtacacaagtcacaataaaaaccacacagtgataattactaagttgacaactaccttatgttgctaatattatcacatgctgagttctattttcctactgaaactaggaaaagaaaattagaactcacaagactacattaaatgttgatatttttggtattttaatgtagccttaaaagattccaatttcaatttcatgttttcactttttaagtgtatagttattccagctatggtaagaaatttaaaaaaaattctagcagtctggaattcaaaaactacctactcattttgaaactgtacagtgaaccagagactattttgtagtgtatttacattttatacaattctttcatttttcatttaacagccacacatacaaacactctaggaagcatccctaagacattgacttctaaaggaatctctatcttgtttttactaatttagcaagaccttgctgttaactaattgttctggaatacttccttccagaaaattattataaaaaacgatacagttttgttactactagcaagaagagctggctccagatatctggtgttaaagggtgtaaatcctcagcattgcaaagacatagcagagttacatagctgttcttcaacatcgaataattccatttccaaagaccatgattgattttgttcactgagctcaaggtgctcaaagcatattatcttcaagaaaaattcttccttcttttttctatatccattacacaccacacagactctcctcagagataaatgtaaagccatgactggaaaaaataattcaaaataggagatagtggttctcacattattttcatgtaagcaatagaaaactgcatggtatcaccaatatgttcttaatcatatttagatagtaaaatggatgacagtccaagaattttattaagaaacattaaaggaggagtcaaaacctacttggaatctgggaatttagtgtactagaactgaagtttcacccccgggctaaccattatgcaacatgttaccaagcaacaggaacattcttttctccctgaagtataaaggctaggagaatggaagcctatacattataggatcaaaaatcactcagctatagcctgtaggtgttatggctttttttgagaatgcttgtatttttgaagtgagtcacatgttttacaaaatgataccgagtgcccttgtttctatgaaatccatgactcaagttttccagtttttagaaattatttgtctggatttggcctacctgaaatctctgactttattatgtgcactaatacatatgtccatctaaaagatatagtatcaaaggaagaaacatgtgctcttttgtatggtcattaaacaaaatgttggcacatattttaaaaatgtaagctccatccaaattgatgtattcctagtcctgtgttgcattctatacctttacatctctttctctaatgcccattatgctcttttttcatccccatccacctctaccaacctaattggttatattctctttattccttagattctaatctatacatcacttattccagggaaactctcctgacccttttcataccaaaatctacccagtctgggtacagtgctcctcttttacattctttgaagttttttttttttaaacttacattattgttaaattactaatccaagatatgttttcttggttcctgtatgtttccatactctactgcacagcaggagaatagggattgaatgaatctatatcattcatttttgtatctctagttcttggcactgaacttacatgtcttgagcttgtgttaattattaattgccaccagaatattgcttaacaaacagccaaaaacttagtgacatgtaacataaacctttatttatcttccaagtcagctgtccttctcacagaaacttgagagcccaagtttctacatttacagactcagttccttctacaccagggtgacagtgcttttaccagtacaatttcttcttaacctttaaatgtgtctaactgaatctacttatactgtaaaagccacacacgccgttcttttaaaggcatgcctctcttcagactgaatcgttgctactttgggctagaggatctttatccaaatgagaaaatctacaaggtattgccttgacttttttagaggttctaagaaagcatctaaggcatcacgcttaatttgattcttaattaagccttgtggccacgttgagaaaattttaagaactttcgctggcagaagattagaaatacgtttgttatccaaccatgcaagttttatcccctctacatcacctctaaattcagcttgcaaagtggtcagtacttttaaattttcttttcctctcctcctcttcctcctctttttccttctccatctccttgctgttgtactgattactcgtctatctctttcttgtcctaccttacatgtagctaaaactagccagctgatactttgaacattttgtcattttgtttggctatcttttggctaaatccaaaagattattagttcattttctatctttcaagtcactacaactacaacgtgtaattaaaaataatattttcccctgtattcatggattcctattttcccagcctccccaaatgatgatttgattattatctgctatgtgtgccctaaatcaatgccacagcttttctttattgcagcaccttgttacttttgtcaaattccacacagttatccattggcacaatgaattttacatttactgatggaaaacatatgacagaggctttcaggtataacgtgattatgtgcaaaattttattattctacagggcagtcaaaggtttattcaaaacatagagccctctatagctttcctattttaattatctgttaaaagtcattgattttgaagtgtaggtaatgaagttaggaatgaaaagcaagtgggttattccatcctaggtagaacgttttaatttttggtactgagcaaaagaggatttttcttgggagatttttctctttctttcttgttttctctgtctctctctccctttctttttttttcctttaacttttacagccttcctctgcaaagtacattctaaattccagctcatttatcttcagacaacttctaaggaaggtaggaagcaattatcattatgctcatttaacagatgaggaaactgggccacaaagaggttaagtgacttattaattataacggctataaccaaggaatgcatagtatcacaataaaggtaataaccaaagatatcgtcacataaaccatcgttactcaaaagagctaagtgtattgatcattttggctcacccacatgacctcaactgcttgattatattaagtttctaaaacatttgccttacagcattggggcagatacagctataacatgttctttatagtctgccacttattctgatcttaccagctcaatagtcttctaaaattaagttatgctggggtgattgtatatgatagtatatggtggggtgatagtatatgttttgaagtctgaattgctagtgtggcatgcctgcaataatttttttgagagcttgagtgattttgctttcagtatactacaagaatgtaagtaacttttccattgagagataaaatgtaaaaagttggtagtttactgcaagtccttattagatctaaaaacatatactattcattagagattgctcctaattttgtaaatataggcaaaacagaattgttgtccgtttttatttagagcaatggtggtaatataagtataatatatttactgtgaagagatttactcattagcagagtaaattctcaaaattgcaacgatagtgtgcttttcacattgaaaaatgtcttctgaaatgaatgtttattttcctcttgctatattggtggtaaaatattttgaaagttccactttgcatatgcagaaaattaacctaaaaataatatttaaagatgagaaatattatctagaacttttttgaattttagatatgtttggttttagagcttattctttaaatgtttttcatattttatatagcaagatttctagttaagtgtagttgtctgtaggaaaaggtttaataattatttgtcagcacatggttagaaatcaggttatgtcttttagtttgcacatgtttactattacgcggattctaataattttccaccactatccagaaggaatgcttttacaatatgacaattagaaattctttatggtacttcagtaagtatagggaggatgtgtaaatagctactcacttgagttggcttgtttatttaggtgctattaactagccacatagctttttctcatgtcatttttatttattttgagttgaatagggagtcttttcccttttgagcacttgtgtttctcagagatgtattttattttgtatgtctaagtgaaaattgagaaaatacatgttctcagggacctgaggaatgaacattcatcttttctttgtaaacctttatcgtaggtttttctatcatggggattgaaagcataaaggtccatatttgagacttgggagaattgtacatgagactttgtgtttacctaatggagactgaattaagaagagatgacttttaagtgatattaaggacatggtattaattggcctactctatagatttatattgaattgggttctgagcaagagctttgagatttgtgttcatgtagttttcttgcctgagcttattttactaccctataatatttagtgaactacttctgctcctttccttgttgtgaaaaaaagcgctattttaactggcaaaagtaaattagtacacaattctaatttacatattgctttgtgttacttgagaacccctcaatattcctttgcagatctaaactaaaacaaaatgttcctcaaacatgacatactgttctgacttggaagatgaaatacctaatatacttaggcttctaagccaaaaactattcttgccaacttgctcacaaattactgattaggaaatagctatggctgtttaggacacatagaaactttatttttaattttttgtttgtctcacatattgaagtttatagataatcttttttttttctttgtgctttaatgagttaaacaaaacataaaagcttgatgtggttgatcaccaatgtatctgggcagtaaggttaggttaatggttaatattgttaatgaaatttttgtttgttcatgttgctgtgttcttcattgtccatcagacatttttttctagaagtctggaagaaatatcgcagtaaagatttttatagtcatataattttcctaacgctcccaaattatttttcctttattaatggtgttgaaatatcgaatgtgggaaattcactaatgttaacattagattacgtggtagtattttgttcaataaaataaggttggtattttaaagtgtcattatatttttattagtgtctaatacagttttaatataaattggtcatgtttgatataaatatttaaaacatgactatttattatgtctttgatttatttgtgtagtaaggaagttatttttactcccagaggttgtctccctccccctttcctcatctaacacacaatttattgtacgtgaggcctgatcctatgtttattacagggatttgcataaggactacaggaaaccaacaccattttactatgttcccattgcaagaaataaaatggtgcctttgagtaaagctgcttcatcagacactagttcagcatgccaagttaaagccatcaatggtgaaacagcagatgtgaaggctagttggcatgaaagcatatgagtcaaagactttcctatgggaaagaaagtgcttcattacactttatctatagtgagaacattgggtttatcaagctgtctgaaaattagaatatgatgagttttattactcttgctctgccagagtgaattcaatggttaaaaagaaagcaataacaccattttaggaattataagaagtgattaggtttttagcgtatttaaacttggaaggagcagcaacttttatcttcgaaagtagcctctctaaaatatctaagggacagaagtttaatccttttctaattgctacatttgcaatatgtattaacgcagctttgggcgctttaactgaataaagaagttgtatgcttgactgaagtgtaaaatctgagaaacaatgttttaattgccttggaaaacatgtgcatgaggccctgccactccagcatacactagtatgctatggttctctccctcccttgtcctccctcctttactctgtgcaaggaccattcctgctgtttgtcaagtcaggttggcagctcaaacactgtgtcccaactcatcagtcttaggagagagggccccacagggagtgagaaaactcaaaagtcagttaatacagtgatgttgagctaacatgtcaagtgctggataatggataatagttgtcactgcaagagttcatagccactggttaggcaacattctgaaggaaattcaagaaggacatattttggatgcaaaaaataggctgagataaatattatccaaaaataccttgacattctaaaaattttagtgctttatatcttacataaaaaaactaaaatgacaaattccatttcttctatataaattgctgaatagaagcatcatttggtatttttaaaacaaacatacaaacaaaaaaacccagactctactttgttaatgttttgaggaaattatacttattgacattgtggctatgaaatatctattgatcgttttgggggtggggggtgttgctgctctgacttttgagtatcagcaaagacatattgttctcatttcttagatagcccattaattacaaggtgaatatcctgaaatttgtacttaatttaaaatatccttggcagtttaatggtcttgattttccacattattatgctgtcttttcagggagaagctattcttttgttgcaaaggcattttagactaattagcatctttggtcagctgaattttcatttgttcatttgttttcctgtctctttccaaaagccacattattctaaaaacagtaatatcactttgttgtttgttattaagagctgattgaagataccacatactagttaagttttttttttctttctttatgaagcaaaaggagatttactattatttgctgctactgccatcttcaatattagactcttatttaaagataatactgtactatttttccccttgggagcaagcaagatgtcaagtgatgcacccttctgatgctcaataatcttaccactttatcatgcatatttgcaaggatgaagcacagtttataaatcatctctgtttattttacattcttccccttaactccagatagatcaggaaaaggacaaaataaattttggtgcttgttcataagtgttgataactgcaaactgaatataataaattcctcaaaaatactgctttaagaaattaaacttggtcaaacattgatggtaaatgtcttattcttaaagagatcttattctgaaacaacttgaatctttgtttttatgctgtgatattagtggctgtggcagtgcctagaattgtttaattgcctaatgcacaaaggtgagcactttgattgatgtgtattcagagaagtactttaataattttataaataaagaactctccagatgactgaatgtgtctgtgtgtgtatgtacatgaagagtgtgttctgtaagaataaggtatgctttcttaatttgagttaaattatggatggttatataattcatttttctatacccagtttccatcttaaatctatttagagaaagaatagttcagggttggcgataaaatgtacttttacatttcctgatagtatttgaattatgcttctgattgtcattagcctattgtatacaccatagcacaagtgagttcagtgaaaagatttgattatctctaaaggtaggtgtttcatttattaagtattgtaattacagctaattagaagctacacattatattagtttgctttgtaggtcccttgactgttttcagaacactatgagcttatggttcatttcaatttattacaaaaacaatttaataaaagccaaagaattgggaaacagcattactaatggatataatttattgttgagtcaatataatagtttaacataattattaaaggcatagaccaagttgtggcgtgaaatcctacattcctcaatcaatacagatttatttaatttctctgggtttctgcttttttgaatttatctcccatagataaatcgagagtatatgtcttatatattgttcgtattaccactgaacatgtactaaattcccaatatatatttgctattatccttattgtgaggagcttaaatgttgaattgttaaatttcggtagcagatgaaaccatttcccccaatatgaataccgtacttttgcaaatacaggttacctatggttaatgctacaatctgacactcagttgcattctcatttcattaataatttggtcctgattttagattattaataaacaaatattctggattactctctaatctcactgaaaagataaagtacatcaggaatctgtttccatgtacacattacagatagtcaatcttttaaaacggattttattattttagtgcagttccatggtcacagcaaaatcaacatcgtgggactttaaatatatcaattcacattcttcaagagtttttgtcagccttctctttcaaaaccagaaaataaaaacccagcctgactccaacaaatagatataactaaactgagggacttaggattccatattgtcagaatgaaaagtggtgacaacccaagatggttatgactgagtgaaatgaattttattaaacacgaccttttttatgatctacctggaaaattttaacaattagggaggtgtttcagaaaggatgcccccaatttggtggtgatagttatgatgagagttgtgttgaaggaagtgttgattgtgacagaagcccccttggaaatttagaaacaaatgtatgtttgtgagaaaaaaaataattaactttcagataaacagcaaaagttcttcacaagaagccaaatatactagtattagcaaaaggataacacttccaaatttagaaatatgtctgcctttgaagctggctgagaactaatttttgtgcaggcaggattcttgagatcactgtttgtggcttttgttttaatgaagcagcttatgagtagcatcaagtcttccaggctttactttcaggactgctgtttccctgggggcctaacaattgcaagtggccctttcattgatttttattaccaatgccagagtgtacataatcattttagtcaaactcttacagctgaaacaagtaaatctattgcattttgaaaataaaaatagtggctaacctgttcccatctttatttattattattattttttctgcattgttagtaaccatgtaatagctgtcacgtctacctttctcactcatctttattctgggtgatgtttctttcctaatctcaggcctaatgtgttgcccctgctgtgtcctggaaatgaggttgcagtgatttacttttactagccattagagaaacactttagtattttgtcttatttcccttctttgaattccacaaacttcgaaagtatcaaaagtagtagtgtactctaaaactcttccaagaaattttactatgtaaggctaaggaataaactagatttttattttcttatggcttctaataaaacatgtgtggttatagagcacatgtaatacatctagtgcactgaggagtaaaatatgaaatttcaattatttaatttttattaaattgaaattttaaaaccaaagcagtgcaagacatttttgcaataaacttaaacatatatttcattttaacctttgcctcatataagatgttgtattatagagcatgtgatttgtgcatgagttgtttccaacacatcagtgatgtactcagtggcaatgatttgattcagtttaaatgatttcttctatgtactactgtaacattgtaatgtgtttatttgaatattttatgtaggtgaaataaattacaattataactatctaaaccatatgattattaaattgaaatgcatactattattttaatcaaaatataattaaattatttttctagtttaaaaatacatatgggcaaatttctaatttaaaatgaagttacactattaagaagaattaaatgaaaatgtagaaactggtactacaactggaagagtaaagaataagagagtctggataaggatatgttaactggtttcacaatgaatgaacattgcaatttgctgcaacaaagcaaaatggaaaagttgtttgtcacatatatatttttaagatattaaactggtcattatcaacatacattctcagaaaatacaaactgaatttgatatgcaattttttttttcttaatagtaaaaaaaagaaacaaggaagttaaccaaagttagagtcaaatgttcaatacatttaaaaatatgttttgacagagtctgaagttacacttttggactgttatacaatggcttggatttttaaacaaagagaccatttttggatggaaagatggtaacatatgttatttcaattatgattagtttgttacaaagttgtaaaaatgagattaaaagaaatattgtaaataagcaaaagatctttaattaatcaactaaaaaattgcccatagtttacaatagctttctaacaataggaaaaatcagttgatcctaatttttaaaaatggcaaaccagtgccttttttaagattagaatgaagtatacaatatgagaaactgtccaattaatactttgggtacattttttcctcaaatgactcccagatttaggagaaaaatttcaatttttgaaataaataaagaactagtggcataggttttttttgtatctcttacagctattaaatattaatttcagctagaaatagaaaatttagtttattacaagatggtcacgatgatggatgctctagctatgttaggttaaaaaaaaacacagatttattataattttaaaacaaaagactgatgtttttccttgatgtgatttggctctgtttccccacacaaatctcatgtcaaattgtaatccccatgtgttgaaagagcggcctgatgggagatgactgaatcatgggggcattttctaatcgtttagcatcatctccattttcaagtagttctttatagcactgtgaaacagactaatatagaaattggtaccaggagagtaggggactgctctaaagatacctgaacatgtggaagcaactttggaactaggtaacgggaagagatttgaacaattctgagggctcagaagaagacaggaatatgtgggaaagttaggaacttcctagagacttgttgaatggttttgaccaaaatgctgatagtgatatggacagtgaagtccaggctgaggtcgtctgagacggagatgatgaacttattgggaactggagtacaggtcactcttgtaatgctttagaaaagagactggtggcattgtgctcttgctctagggatctgtggaactttgagcttgatagagatgatttaggatatttggtggaagaaatttcaaagcagcaaagtattcatgatgtggcctggcttctactaacagcatacagtcatacatgttcacaaagagatggtctgaaattagaacttatgtttgaaagggaagcaaagcataaaagtttggataatttttagcttgaacatgtggtagaaaagaaaaattcattttctgaggaggaatttaagcaactggctgcagaaatttgcataaatgaagaagagtagaatgttaatagccaagataataaggaaaatgtctccaaggcatttcagagatctttgtagcagctcctcccttcgcaggcctagaggcctaggaggggaaaaaaatggattcatgggccaggtccagagctctgcagctctgtgcagcctcaggacatggcaccctgagtagcagccactccagctccagccatggctctaaggatccaaggtacagctcaggccattgtttcagagagtgcaagccccaaaccttggcagcttccatgtggtgttgggcctgtgggtgcacagaaggcaagaatgaggtttggaatcttcacctagattttagaggacgtatggaaacacctggctgtccaggcagaaatttgctgcaggggtgaagccctcatggaaaacctgcagtaggtgtggaggggaaatgtggggttggagcccccacacagagtctccactggggcactgcctaatggaaatgtgagagaagggccactgtcctccagactctagaatagcagatccaccaacagtttgtatcttgcacctggaaaagccacagacactcaacactagcccgtgaaagcagctgcagaggctgtaccctaaagagccacagaagcaaagctgcccaggccttgggagcccacctcttgcatcagcataccctgtatgtgagacatggagtcaaagaaggttattttggaactttaagatttaatgactgccctactggattttggaattccatggggcctgtagccccttagtcttgaccagtttttccctgttgcaatgggagcatttacccaatgcctagatcttcactgtatcttggaagtaactaacttgtttttgattttacaggctcataggcaaaagatacttatcttgtctcagatgaaacttggattggacttttgggttaatgctggacactgttggaaaagcatgattgcgttttgaaatgtgagaaggacatgcaatttgggaggggaaagggtggaatgattggtttggctctgtgtccctacccaaatctcatgtagagttgtaattcccatgttttgaaggaggggcctggcaggaggtgattggctcatgagggcggtttttaatggtttagcaccgtcctcccaatgctgtctcataagtgagttctcatgagatctgataattttaaagtgtgtggcacctaccccttctctctctcctgctaccatgtaaggcatgtcttgcttccccttcaccttccatcatgatcatatgtttcctgagctctccctagccatgtagaactttgactcaattaaacctcttttctttacaaattactcatttttaggtagttctttatagaagtgtgaaaatgaactaataaatccttttagctttactatatgacactgaaattatttgtgttcagttttctgaagcagactctgtgacaagtgtcatagacacagttgttaatattatttagtgtatatgtgtaagtgctatgactcattgccagtttgtagaactattgaaagaaatagaagataacaaatgttaatggttttgtaattttttgccaaattgctctttggttgagtcaaagaatacaaagatttactgtattgtctattcctactcaaagatgcatgaaattaaattatttctagatattcaataatcaaagataaaaataatagtttgttttatgttttttgtgctaatatcacactgaacaaaagcaaactaaattgaatttcaaaagaaaaaaatattttttatctagaaagctgtaataattcattataataggaaattatcataataaaggtcaataaaagtgatttttcacatttttttaaagagtcaatatacagattttagttgctgtcagcagtattatagcaaacttgtagtctcaaaaactacatgtaaaatttaaaaactttgttttgagattgataaatttagagattttcagtttatacaattttcctttgacttcagtgttaataattcttagttgatgtaagcattagtaaattacttcacttggaaagataaacagacataacttttgaacaagaatatgtgctttgaagccaaattaattcttaaaaagttaagaaagatgaacaagttttaccaacatgttgtgtatattacaggaaaattgcttttagtacttagttcaattattggaaatttgtttgaaacaacttgggtatatggaactagtattttaactgatttttttttagctttttaggtttatgcaatcaatacaacttaagcgtcttaaatgaaaatttagtgtctgaattgagatatgttttcagtgtaaaatttacgttggatttcaaaactaaaataatgtgaaacatctctctaataatttttatattgagaatgtctcatagtcacttaaaatccagtaaattcaaaatggagtctttatttgttcccagtttcatcattccatgattattctccattctaacagagggcaatgccatcaatgctgttgctcacctctcatatctaacccatgagcatgtacttttggttgtaccttcaaaatacattgcatctaaaagctattcacagctctccatatctatcgccaacaccttaatctaagtaatcagtaagccatttagtaagctcaacaccttaatttaatcagtaagccatttagtaagcttataagtttactactattttgtctgcatcatcagttgttccatttcaatcactttcctaagagtatttaaagggatcacaaacaaacaaataaatcaacataactcctctgtaaagtgagttttctctttactttttacttataacacatgttccttccatgataacattctaaattcattgttttcatttatgttattcttcttgtgactagaatgtgaatttcatgaggtcaaagacttagtaactagagcattctggtagataatagattctctatctactgtttttttttttttttcatttttatgagatagcaaattaatccttgtaagtaaattaatcaatataagattattaatcataatctttaatcatgtttatgatatagtaaattaatcaatataagtaaaataagccaggataaaccattttacataccctaattgttacaaaatataacatatacacagaataattttccaaaacataatttgtataacattaggtgttttgagattagtaaagttagtatgttaagaaaaatttagaaagtgaagaaaatggaaataagacaataattattaatgagaacacaaacatgcacacatatcttctgatatatataatatgtatgtgtgtgcatacacacacatacctatatctgtaatgaaattggggcaatgctataaacataacttcagaagattttctaagcctgggcaacaacccccatctttacaaaaaataaaaacattagccagggtgtggtggcacatgactgtagttccaactacacaggaggctgaggtgggaggatcatttaagcctgggaggttaaggttgcagtgagtcgtattcacctcattgcacttagtcttggattgctgttgaaaaaaaaaataagaaaagaaacattttgatttttaattagctattatgaataatgcttatttgtaaatacgtaacaaactatctaatcattgaattaaaggaatatgacagtgtcttcatcgaagccatgactgcaccagaacaagttaacacaggcaaggcgattattgtagtaaagaggagatgccaggattcagtctgaactcaattctactgctcaaaggactggagggtgtttaaaagttggagagggggatggaggcagagtggtattgtaaaccatttatttttgctagttggtcctacccaatggaaaacaaactttttgatatcttcatgacaggagatagttctacaacttggagcaaggtacccactgaagttaaatttctaccctcccacagagaatgttacacagggacactagcttcctagatgattacagttcaaaaagggctcctaggaccttgagcaaaacgttgctaccttgtaatattagcaagaaacttttaaaaagatttacattccaaaagagtcaaagaaataatttacgattataatttttcaaaggtgtgctctgagaaaagagaggtcaggggcttagagtccagaagaagcatgcctaaagtttaatcaagctgaaatgaatgaaattgtcttgatcacttgatacaacaccctttagagacattgaagtaatttttaatactaacaatatgtaactgggtgattcttcttcctattctcatttttagtgtgaattatagagtattgagaatttttaatgagggaaatattatcattattttattttgaattgttttgatcataacaggaattaaacattttaaaatgtttataacaaagaaactttaatcttacagacttaaatgttggaatatcattattttaatttggtttaaaaaattgtatgcagtctgcattccactaagtttcttaacctataaaacaagtattttttaaggagcattataagtacagagattcatgctaatggcattcagctcattaataattatgttgtagtaaagctgagaaaatgtgatataagagaaacacttgcttatttaaatatgtcagttttatttccttctgtttgctttgttaaaacatgcatataattttggataaaaatgtgttggatactgaaagcctgcctcttattataacaaaggcattaattagacatgagaggtccgcaccatgatcccaaatgttatatttcaatacacatgttcagaaagtaatctttcagacattagtaggtgtgttaaatgactataatcctgagcacctacatcgacactttatcctttgatatttgtcagacatgcttaaccccaactaggagaatgttgtttttattaataattatttcaggtaatacctgattaggtctaatgagtgcttggcagtcttcatattggaatgaagtctgtgtgaacgtttaccaaaatgtagaaaccttggaatatttgacaaatgtttatttttaaaaaatggcctctaatctcagtttgaatttacacttattttatttttcagtttatttgtttggaaaatattcctattacctttaaattgactttttagagaagttttacaaatacattatttttaaatacaagaacaaacaggaaaacggagttaagttttatatggcagtggtgatagaatggttgggtaggagcatgaatactgagtaattatatttattatgtccttattcctgtgtcttcaaaacagaaaatgatttgaagaatcttagaactgtctttttttttttaaagtctcttccgtttacccagtaagtgacataagccacaagttactattttttacatctaaatcagagccagtgttaaccatcagtgccattttaacgtgtgatcagttccttaactaatatatatatatatacacacatatatagttatagttatatatagttatacataatatagttatatataaatatatttatagttatatataatatagttttatatagttatatatatacacatacacacatatatatgatacaatatatatgcaagcagatttttcagacccagaataaaatgttaaaaggtttttttattgttttaattaaatagagacagggtcccactacgttgcccagactagtcctgaactcttaggctaaagtgatcctgctgcctcagcctcccaaagcgttgggattacagggatgagccactgtgcctggcctaaaaagggttttaaagcaaaacaagaaaacaatcaaatttcatttatttattaaagaaagtaaataaacagatatcaaattgccaatatgaggcaaactcagggcaaatttaatttgcacctgggcacatttacagaattttgacatggcagttacttgactattcatcaaatgtgtaatttcctccagtcgtagcacacccactgtttaaatttgtgttctgaaaatataaacccaccacttaaaataattgcttattttattaattcaaatatacacacccattgattcataaattatcaacagtttaactttatgataaaaataatgtatatgttctatcttgtctcatcatttcttctggctatccatgatggaaagggagaataagagagcttttgttgttgttgttgtgtttttgcgattttttttttttgtgggtaccaacacttttcttttgcctccataggatttttaaatgcagccttataaccatgttaaatgcctagatttgattataatagaaatttatcaaattcttttaatttacacactcaggtttcttgtcaggtctaggaactcctctttgattatcttttttttgttatccttttaagttctggaatacatgtgcagaatgtgcatgtttgttacatagatatacacagtggtgtgctgcacccatccaaccgtcatctacattaagtatttctcctaatgctatccttcccctagtcccccatccccaaccggccccagtgtgtgatgttccctgccctgtgtccatgcgttctcattgttcaactcccacttataagtgagaatgtgtggtgtttggttttctgttcctgtgtttgctgagaatgatgctttctatcttcatccatgtccctgcaaaggacataaactcatccttttttatggctgcatagtatttcatggtgtatatgtgccacattttctttatccagtctatcattgatgggcatttgggttggttccaagtctttgctattgtgaatagtgctgcaataaacatgagtgtacatgtgtctttataagtgtagaattatttataatcctttgggtatatacctagtaatgggattgctgggccaaatggtatttctggttctagatgcttgaggaatcaccacactgtcttcatctttttgaaaatattatatgtctcaatcatgctgatttcatgttcaggaacagaacagaaatgagaaaatgagaaatgagtgagatctgacattggttttatgacctctatttattaaataactttctcattttttatttctcattttaatctcctgattttaagaaaatcagcctgttttgtaagttttttctacctgtttcaaaaagtcttataggcttgtatcacattgggactacaaaatgtgtttccattttgttgttgttgctggtaataaatcattttctaaaatctcttctccctctaagttatcaagataatactccttttcttgttttttggaccaatttttatagctttatgtttatctcaatctttggtgagaggaatttgattgggatttgtggttgaccagaggtcacttgaataaacctctctctctactaaaacttgaaagcaggcctacatgcaaactttgtagtccagttatcaatctcaggatccaaaattgttgttttgtgttttaacatggctctttgggcctgagatagaatggactcttaccctcaggaccttaaatctgatactctgaatgatgaagcagccccctttttagggcttctcttatcttccccacattttcatgacaaatgaagactattcccacctgcctctggaataggacagtcttccctgcccactacttgcttagttatttcctatcagttgtagcctctatttttttgtttttcatttttttctttatgtttttttattttgtctttattttttgtagcctctaaattagcacagaatacaagtactaacagtagtgggagccaggaaacacattccactggattcaaaattaatatctacaaaggtgaaggataactgctaagtgtactggatcagggagaacttataggtggcatagtgtagacaaagaaacaatggtatgcctaacacctttcaacatggtagtagcatttgacttcaagcaagggcgggccatagattttatttttaataaagtttaagcgtcattgtagttaaggacatttatttcagacttcagcaagaagttgtgtgtcagttccaatgttctgttgtgaatcgtcatttgttgtgtcttaccatattaatatattttactgtgatgttagtagagaaatcattgagtgcagtcatccaaacaccttttaaaactggaaatacataatctttaatgctttaaaatgtatttgcatatatgtgaaagtatcatctaaactgcaatcattataacccatgaagtgtgaagaaatcctgtattttctattttctttaacatgatggataaaaggtatttaagagagttgagaaactaacctttagtcctgtgtcaaatctgatagaattcatctttcaactatctgttaccactttctagacactgccaatagtaaaatcaattgttgaagtaaatggaatggcttttggtataatgcacaaatgggtttaaattgaggattcagtatatgcgtgttttgtttaaatatttttgctttaggtgtaggttcatatgcagctgtaagaaataatacagagacattccatgtagactgatatggtttagctgtgttcccatccaaatctcatcttgaattgtagctctcataatccccacgtgtcatgggagggaaccagtggcccagtggcaagtaattgaatcatgtgggcagatttttcccatgctgttctggtgatagtgaataagtctcatgagatctgatgattttataaagagtagttcccctgcacatactttcttgcctgctgccatgttagacatgttttgctcttcttttgtcttccaccatgattgtgaagcctccccagccaagtggaactatgagtccattaaacctctttttctttacacccagtctggggtatttcttcatagcagcatgagaagtaactaatacatagcctttaagagtcccacaatgtaatatcatgaaaagcaataggacattatcacaacgatgttggcattgttagagaaaagacaggtaacatttccgtcatcacaaacacatcatgttttccttcaacagtcataaccttttttctcccacatccccttcgttagctcttgacagtgcctaatctgttctccatttcagcaattttgtcacttcaagaatgttacataaatggaatcatcctctatgacggaaccatccagtatgtaaccttttggtattagctttttccacttagcttaattctctggaggttcatccaggttgttatgagaatcaatagtctgttcctttttactgctgagtaaccttcaatggtatggttttaccacagtttatttaagcatttactggttgaagtacaactgggttgttttggggttttggctattttgagcaaagctgctatgaatatccatgtacaggttttgtgtgaacattagcttttctttccatgtgaccaaagcccaagtgtgcaattgcagagttgaattatagttccaagttttgttcagttttttttttaaataaaagctctattaagatgtaatttatataccatgtaattcacctgtttaaagtaaaaagttcaagaatttttagtatattcagaactgcataatcaccacaatattttttttttttttgaggcggagtctcgctccatctctcaggctggagtgcagtggcacgatcttggctcactgcaagctccgcctcctgggttcacgccattctcctgcctcagcatcctgagtagctgggaccacaggtgcccgccaccacacccagctaattttttgtatttttagtagagacggggtttcaccgtgttagccaggatggtctggatctcctgacttcttgatctgcccatctcggcctcccaaagtgtcaccacaataatttttaaaactttttcaacattttgaaaataaaccatgtactcattaacaatcattccccatttacttaaaatgtccactctccaccatacctaataaaccactaatctgcttctgactataaaacttcttagtctgaatatttaatgtaaacagtgatatagaataaatgctctttggctttaactgaactttcatctgtgtttcagtgtgtatcaaaattttattcttctttttgcagaataatattgtactacattgatataacaaattttatttatctgtttatcagaggatggacatttgaattgcttccactttttggatattataaataatactgctataaatattaatgtatgagttttggggtagatgtatattttaatttttcttgggtctataagcagaattcatgggtcaagtggtaaatatatgtttaaccatttgaggaaaatcaaactactttctaaatggctgcacaattttacattgcctttagcagtgtacaagggctccagtttcttcacatcctcaccaacacttactattttctgtttttatgattatagccatcctagtgtgagaaagtgctatctcctcatggctttgatttgtacttccctgatagctaatgtggttgagcatcttttatgtgcttattcaccatttgtatatctttggagaaatgtttattcagatcctttgctcatttttaaattaggttgtctttttatcattgaattgtaagagtatttttacattttatagatagaaatccctcatcagaaatatgatttgcaaaagttatttttccattcttgggttatcattttactttgttcatcgtgtcctttgatatacaaaagcttttactattaatgacatttattataattatttattgtttggatccttgcttttgatgttatatcaaaggagacttttcccaacccaaggtcctaaagagttactactatatttttttctaagagttttatagttttaacttttatatttagttctacaattcactttgatttaatttttgtgtatgatgtgaaggacaaacacaattccatccctttgtatgtagatatcaaagtgtcccaacacagtgtgttgaagactattctttccctctttgaattgttttggtactctagtaaaacaagaaatgaccataatgtaagggtttatttctgaacctttaattcttttcaattaatctgtatgtctatccatatctacataccacatggtcttgcttactgtagtttggaaattaggaagatcatcagtttccttttttatttcaagattgttttgactatgtcaggttccctgcatctataagaattttgggataactgacaaatttctgcaaaaagccacatgaggtattaattttatgtttatttgggaagtattgttatcttaacaatattaagtcttttgatccatgcacttgagatgtttttcaaattatttaggtcttctttaatttctttcaatgtgttttcacttttattattagatcttgcacttctttaaagaatagatccctctgtattgtattctcttcaatactattataaatataacaatttttataatttcattttctgatagttcaattttatatatagaaatataagtgatttttgtatagtgattttacatactgcagtgggttagaactcttctattaattctcaaagtgttagtagatatatctggatttcctatatacaagatcctgtcaactacaaagagagatagtttaaggttttctttccaatctggatgcctttgtgttttttttcttgcctttatggcctggcaatatgagaattacagtataatgttgaatgtaaatgagaaaggtgtacactgttatcttgctcctaatatcgggggaaaacatttttccttacaccattattacattaggtgtggatttttcacagatgccttaaacaatgttgaaggcattcccttccttcattgattgagtgcttttcaatcactccagaggtactgaatttgtcaatgcttttcctgagtttactgagatggtcctctgatttttcctttattttactgataaaatatattatatttatttgtttgtgcactttaaaacaacctcacattatttaattaaatcccacttggtcttggtgtataattatttttctgtgatgctggagtcagtgtgctggtattttgttgatacattttgcatctatattcataagatatattgatatgtagtttgtttttcttgtgatttttttggggggttttgatatcaggttgacactggcctcatggagtgagttggaaagtgtccctgcctcttttgctttttggaataatttatgaagaaatggtattaattttgctttaaatgtttgacggatttcaccagtaaagccgtttggtcctaagcttttatctccaggaagtgttaacaattatatatccagcctgggcacagtggctcatgtctgtaatcctaacactttgggaggccaaagcaggaagtttgcttgaatccaggagttcaaagctaccataggcaacaaagtgaggtgagttcccatatctaaaagagaaacaaaaaaaagcagacaggcatggtggaatgctcccacacacccagagtcccagcctgagcaacagagcaaggccttctctctctctctctctctctctctctctctctctctctcccccccatttcttttacagtcagatttggtagtttgtgttttttaaggaatttatccatttcatctatattgtctaatttgtggccacacagctatacatattattcccttttaatcctttttttttctgttagattgtaggcaatcatctcactttcatttctgatattgataattttgttattcttgctaaaagtttgtaagtattgttgatcttttcaaagacttggctttgtgtttctttgattctctctctttttcaagttgttgcttcattagttttcattctagtttttattattttcttccttctgctttattcgagtgtactttgctcttctttttccactgctttatgttgaaggttaggtcattgatatgaggtcatttttctttttaaatataatcatttacatttataaatttctctctaagcactgctttaacttcatcctacaagttttattatgtcacgtatttttattcagctaataatatgtccttatgtcagtgtgatgtgttcttttatctttaaattactaacgcattttaaatttccataaatctatttctttctgttattaattctttgtttttaccctttggcctaagcaaaaaacttatgactaagtcctcatttctatcagaattttgggataactgaccaatttctgcaaaaagccacatgagatattaattttatatctatttggagaatattgttaccttaacaatattatgtcttttgatccacgaacttgagatttttaaatttatttttaaagatttcaggggtacaagtgcagttttgtttcatggatatattgcgtagtggtgaagtcttggttttaatgtgctcatcgccccaatagtgaacattgtacacaataggtaattttcaatcctcactcccttcccaacctcctaccttttcatagctccggtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgttaatatttgaggttttaataatagccattctgtctggtgtacgatggtatttcactgtggttttaatttgcatttctctgataatttgtgccgttgaacatttttgtcatgtttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgtaggttattagtcttttgattgtgattttcttatttatttatttttattatttatttatttatttattttttactgtgcagacactttctagtttaagtcccttttgtctgtttttgttttagttgtgtttgcttttgaggacttagttataattttttgttgtttgttttggccaatgtccagaagacattttcaaaggttcccttcaggaatttttatagtttcagatcttacattcaggaatttaattcatcttgagttaatttgtatatggtgagagatatggatctagtttcattcctctatgtatggcaatccagttttcccagcaccatttattgaataggatgtcttttctccagtgtatacttttgtcaattttgttgaagatcagttggttgtaggtatgtggctttattgatgtattctatattacattccagtgatctatgtgtctctatttataccagcaccatgctgttttagttactgtaaccttgtagtatattttagacaggtaatgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctgtagctagaaattccaggactatgttgaatatgagaggtaaaaatgtgcatccttgtcttgttccagtttttaaagagaatgttttcaactttttcctgtttagtatgatgttgcctatgggtttgttatatatggcctttattattttaggtaagtttatatgatacctggtgtgctgagtgtttttatcattaatgggtgctgaattttataaaattattttttctgaatctattgagatgagcatatggtttttgttttaaattctgtttatgtggtgaatcacatttattaatttgcatgtgttgaaccattcttgaatccctgaaataaaacccacttgattatggtgtattacatttctgatgtactgttgcatttggcttgctagtattttttagaggattattgtgtttacattcatcagggatattggcctatagttttctatttttgtggtattcttgcctggctttggtatcagggtgatactggcttcatagaatgagttagggaggattctcttctcatcaattttatgcaacagttatagtaaaattgataccataaaattgattgataccatcaataaaattgatcaattttatagtaaaatttatactggtatcaatggcttcatgtggcaatcatatggcttcacatgtctggtaacatttggctgtacatccctctggtcctgggctcatatctgttggacaattttttcattactgattcaatgtcattactcattattgtctgttaaagatttctatttcttcttgttacagtcttaggagaaattttctctagtttttctagtttgtatgcctagtgatactcatagcagtctttgatgatcttttgtatttctgtggtatcacttgtagtcacacctttatcttttctgattgtgcttaagacttctctccatttttcatggttgatctagctaacaatctatcaatattgtttatgatttcaaaaagccaatttttattttgttgatcctttgtatttttttgttgttctcaatttcatttagttcttttctgatctttgttatttcttttcttctctgagctttgggtttggtctgctcttgaatttctattcccttgagggacttgttagggttgttaatttggaatatttctatctttctaatgtaggtttttaacaccgatgaaaattttgttgagagtccctttagaagtgattagacacttctctcttgctgcttttaggatttttttccttcatattggctttggataacctaataactatatgtgataatgagtttcatcttgtaaagtatgttccaagtattcactgagcttgttgtatttggatacctaattccctggccagaccagggacattttcctggattgttcccacaaataagtttccccagctttttcttcttctccctcaggaatgcctataattcataggtttggttactttacgtaatcttttatttctcaaagcctttttttagtgttttgtttttttttttttgtctgacttggttaattcagaaggcttgtctttaagctctgattatttttcttctacttgctctaatggtaaggcttccaaatgtatcttgtaattatttcaataattttttttattttcagaagttctgtttttttaaaaattatctgtaataatttttaattaacatcctgatttttcttctgatttctttggtttttagctttctcttggatctcattaagcttcctcacaatctatattttgaattctttatctgtcatttcagaattttcatttagttttggatccattgctagacagttagtgtgttcctttggaggggttaaagcactctgtttttccatggtgccatagtttttatgttagttccttctcatcctggagaaattgtcatttattttttaatttactttcttttagatggtacttttttaaattttttctcttgagggcgtaactgtaatgtatgttgtgtagggctgtttggcttcaattctgggtgctttcaggggccaagcctctgtatgagttccttggttgtagataaccttggttataaatacagttcctttatgtggtggctttttcaaatgctgattatagtagcaatgtactcggcctatgagcaggactaacaccttctgtgggactgaggttatggaagtctcaggaaacttaccttattccgcagcacaatgctcttctgacagaagatttttaatttgattgtgcagtccaatctccagttcattaggtggtagttacgggtaacagctgtctgtggtatatacttgatctttgtttactgagaagggctctgttgtcacatgtagtgggctggtctgtcaaatgactggtgtcctgacttccctgctgaagggtacaggtgggacaaagctgggcagagctggaccaccaaactcaccctcagataccccaatgataagttaatgtatccaccttgactggagtgacagggagaggttatagtgaaagcctcccatgtttctcccagttccacatcatgggcaggcaggaaagtggtcaacctccacatcacacccttcttccagggctcaggactttcatttcagatagacattgtagttcatcttcaggactcaatgtaactgagggttccagcaaatccctaccccatagctaccaacaaaatgacctcgggagaaacctctttcctcaaccccaaacagacagctttgtggctcactcacctgtactctgcagcgggaatgctgctgttctgtgtagagtgagggatggactccaccattcttgcaagctgggctaatggacataccaggagtgggagtgcaactcctcctaatagtcctataatggttctccctaggcatacccatgccaacgccccccacgaaagaacagctagctgcagctgcatccgcagctgtgggtcggcaggcagaagtccccctatccatctttgttcccaggcaccagtgccacctgctgctgggatggaaccacactctccctgacatagcctagcaccatgcccacatttctcatgcaatgggcgcagtaatcttcagctcacaagtggggagctcttgtgcagaggagagtgcacactccggtttttgttgttccaagggcacttcggcatgtgacactctcccttcccctagggagagctcaccctgaacgttagaattccgggaatcccacagctcccctttatcctgctggtcctttctggttgctgctgtccaagtagattctaaggaatgtctataagggatctactggtgttgaggcaagagctgagactctttgggtaggatagagatccacaatatgtgcccaactggtatggcacctactacctcagcttgggtcttgagagtggagggatggtaaaactgcatgagctagcagcctagtgctttgccctcaagaaatttgtaaacacaacccacagcagtacttgggttcatgagggcagaggggctctctgacattccagaaatcagcagtatgacacaggggtgaggggagcataaagtacccccatctaccttatccatgggactccaagatcttcaggggtcaatctctgccagactcttgcttccttctttttgtgtgccccagctttttcccatgggttctttaatagactgtggcactcttccctcggtattccactcaggatgtgattactaactggcaactctggttcttctttatgaaaactggcattcaatgcctctagtcagccatcttgaaaaaaaaaacctcaactctgttattaatttgtaatgttattccattgtagcaaggcacatgctctgtgtgctttgaattatttcaaatgtattgaggcttgtttcatggcctggaatgtagactaccttggagtaccatgtgtacttgagaagggtgtatattttgctttattttgggtggagtgttccataaagacttcttagttctatctatcctattgttgttcaagtcttctatttcctaatagaacttctgcttatttgtcttatccattattgaaagtgagctactgaagtcctcaactctttttgctaattctccatttcacattttaattctgtaattttttgcttcatattttggggttatgttgtttggtgcatatatatttataattgttccttttttgataaattaacattattaaactagaataacaaaattgatctcaatataactataaaatatattttttatatctagtgattgtttttgtttttcaaacctactattccttatttctgtatagcctctctgtcttgtgatggccatttgcctgacatatcttttgctatctttatttttaaccttcctgtatctttgaatataaactgggttttctagataaaacaggcagttgaattttttttttatttttaatccagtgtgataaactgccttttgatttgattgtacaacagattagaatttaatgttattattgatatagttaaatttacatctgccaattaatttttatctttctaatgtctcttttgtcctctctcctttaccagttttgcattaagataatattttcttgtgtaacattttaatttaatgatttttctttgtattttttgttattttctttgtggttgatttaggacttatatatcttaatttataagaatctatttcatatttatacttatttaggatttttttttttttttttttttttttttttttttttttgagatggagtctagctctgtcgcccaggctggagtgcagtggcaccatctcagcttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcgccctcccaaagtgctgggattacaggcgtgagccaccgcgcccggccacttatttagtttaatatagaaacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatcattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctgatcccagttagaagtggattttccttgtgttttaagagcctctagctattggggtttcagtaccagacctgttagcaaccctgtcctattgggaaatgaaggagaactagacatgggtgtttacagtgtgacttttgtgggatactacttctacctgctaggcagcctaatgtctagttctcaaacccgtgaccagggggtctcgcacacaggaaaggtgtttatattggaagatgcccttgtggctcttgtttgatccctgttcagtttatgcctgcctaaccattgctgcagcactgggatcctgactttttgttcttcctggcatcccagggaaattctggcctggggaagctgtagttctttgcatggaaggtgcaaatttgatacaccaccacagtaagaaacaagctcaaagactttttacttatggatcctaggcagggagaacacaatgagtcaggaggacagttctctgtctccaggtcatgcaaggcagaaatgtagagtcaggcatagagagagagagaacatgtggcaattagcaggatacataagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggacatgtgcttaactgctttgcatcttaggtgtcctcctgtaaaactggataaagtaccaggtgtatagtgctgttttgcatatttgcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaatgtttcacattagtcttaataaaaaaagtaatgtttatttttgtaataatttatgtaagatatagctcagtgaaaacatattctccttgcatgttatcacacacaattgtttttgaatgacacaataatgtattgacattttatacttctgatttcacagtatatttgccattacttgttagtaacaaagcatcagtcataaatttgaagtctgtggaattggttaattttacctcatttgagtaaatctcaaatgaggtaaagtataggaggtaggaggaaggaaggaaggagaaagggagtataataactaattggagaaaaatatatttgataaaataatccttgtctgtataaaacaattttcaataataactgatatgtttccctaaaggtagtttataatctattattctttttataataattatgatgttatgtggtttggatttctttgtaatccacattagatagcatagaaactagtatataaccaataaatatttcgtgactgcatgtactttgtgtataactttatgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaacaatttatttaggtaatgcaaatatgtcaacagataattgcattatagcagaagtttaatataaaagacacaaaagttttaggtgtgtcctgagaagtgattgatttctgtagggcagaagtaaaggagaaatttaaaaaatatattatgaatgttgcgatgcccaagtagatcttgagagtaacagaagtaatagagtttgacaaggctggagttcctgtaagaaaataagcatattactaaatccactttattctaattaattatttgttcagatcttaacttttataacaggatatgttgaggacctgaatgttctagtcatctgtttcccctgagcacataatgcaatcaatggcctgtgataggtgctcaagaaattgtcaatgcataagtgattcaatggataaaggaagagggacgaatatttgacaggcccatcccctcctcacttgctctgagctgtgtcctgagattatgattgataggatatcttatgaataaatccatcaaaactgagcaaactgggaaaatattaacaatttaatggttgatttttagctaagtcttataatccaaggcaaatacaatttcctcttttatactctccagtacttgttatgtactcatgttttgtagacaataaaaataaacttaattttatgcttggtaatcaataatttatagtgttttattgtgatattatgtattcatgataagtaactcaatgtaatattaagctaagttttaagttacctaaagatcttgaaaattttgttcaagctgacaaactataaaacaaaattatagttgaaataaaaagattgagagaattatgattcaacttctttaaaatatatttttataatattaaacatttttataggaatacatttttattttattagtaacctagtatacaaactttcaggaattcagattaaatagacttttcatgaggaaccaaacctaaatcttataaaaattaaattgcctacttgtatattacttaacattgatactttatataaagtcatataactgtttttcttctttaaatcattattaaaccagttgcgatttgatattttatagaaaatgcctttggggaattttttagaggttatcacaattcatgtattagaaattattttaaaatattctatgtatttgggaatattcaatttacataagcactttttaaaaataaattataacagtgattctttagcttaagagatgccacaatttaatgtacttttatcctctggatatagaagtgaagacctttctcaatttcaaacacagttgcatagtcacaaagacgacttgtacctgcagtctcatcacttcagtcacgggtcaaaagtgaacacgaaaacccaaccaaaaactttctagtccggatatcaggtgttttccttcccagtgggcaggaaacactttcccagttgatttgagatctacgcaaacaggtaaacaaacaacaagccaacaaaccagaatctcattcatgtttaacccaataacgaatagagtttcattattcatctcatagaaattaccaagtggtcagaacagaaaaccaaaatcttagtcattgctctcactaatgggggataatttatgcaccaacaagatctagaaataaaaatcaaaacaacaacaaaccaacaacccctcccaccccccaccatataaacagtaggagaaataggaggaaaaaagaactggagagtcaggaaaattaaagttctattgacgcttgagattctctctgagaactagaaaagatgtgacttcactcaaagatccttgaatgtgcccttctccagtaatacaatttatttggctctgtcaagtgaaacaataaaatataattttcaaaagttaaaaaaaaaccatgcatcttatgcaaatataaactgaacacatgatgaagattttattcaattattaattatggttcaaaggagaattttaaggacataaacacataggtacacacaatcaggaatgctgaaatgcatttgctaatagatgcaaagctttttaaaaccctttatatgtgataaaataagatgtttaggagttatatttcctacagagttaaagcaatttttttctttactgaataaaacaaatttgcattgctattaacaagaataatttgcattagtgtcagttttttacatgacaacttctactcctacaaaattgctactagtctggtcaatagaaggtcagtcaaaggagcatatcattatggaatcagacaatccccggagagtatgcaggtaatatccagcactctacaatatgaaacaatcattttaatatttctagatcctcagtctcaagatttgtttcttcacattgatttggctgagaacataaagatacatactttatgttcgccttatcttctcactttcctttcacacttgcacttcttgaacttggtaaacataaatcacactttcatccacccatcaaaaatgtgtgttctctgaggggaaaaaatcactgtggcatacacaaaaatattaattagaagtattgatgtttaagaagacttctaaaatgaggatactgtaaacctaccccttatcttcataatagatgcatttccaatataaatttattcattgttcataacacaatgaatacatttgtccaattgtgggctaaaaatagttttaattgtaactcaatagagaagaatattttaaacattaaagactcatgacaataaattttaagtaatatttaatcttaacactatataaacattttgaattataataaagtgactgaataaaatatttgcaagcataaaatatatttccttagaataacatgttatagaagtagggaacaacaatataaaagaaaatgaaccacatataatttataactgttgaaaagaggagttgggttgtgtattttttaaatgcatgattgtgggtggcaaacagctattgtattaatattctacacaggatgcatttgaagaagaatgtaacacttttccttaaaatatgaatagtgaaagtatgctagaagttatgtttatgcattttttagttcaatgataaaatatttgaatttgtatagcttcaaaatatttgttctatagcctgtttaatttatgttatttctcagtggcttacttttaatttcaggttcatttttccccaaattttcacttgttattttttaagagaaaggcctatgaaaatatgaacaatgacctcaaataattgatttcaactcataaaaataacaaagaataaaggagtaatactgagacaattgccgctgtttgacaactatgatagagcatatgaaaggataatttccgaactgatagtttttgttcactaatggaattatttttgtcttcataggatatacttttagtcttaatgcataatatttaatccatcacattaatctttgtagatgaaatgtcaatgactacatatataggattgtgtgtcttagataagtccacataaaacataaattggagtaatcataaggagcagcatacgagtttggtcagcaactgcttggtttgcaaattgtatgtgaaagacttggagttataataatggctctaggcttaaaaccaccatattaaccctcttgtttttactatcttcaatttattatatggcttggagagtgtgttctgcatgtgtagctctgtctctttttcctataatgttctcaaccatctcacctaattcaattttgtcagcactttgtaaaggcctgttagaccaatcccactgaaatcacatgcctatttttatatctacagcattttatgccctttttttggtgtttgaaaccttatacacagagattttcctcaataaaaatttgttgaattcattaataaattaaaaaataaaccaatcaatcaaatctaatgccaaagggccagagtaatgatttttttttttctctaggatttttggggcaaaaatgtggccatctcaagcagcttcaacattttaatttagggcaagcaagccccaaaatttgggcttggcccaggatggttcttgccatcacccaggaaagaatttaggcagccagtgttattagacaacaaattttattgaagtagcagtatacagcagctgtagaggtactgctcctttcagaccaggtcaaccccacagacagtgtgcctaaagtagcagctcagaggcagtttggctgtcgtatttatacccactttttattatatgaaaattaaatggtggattatgcagacatttataggacaggggtggtaatttccaagtcatcaggtcattgtcatgttctttaaagaagcagtaacatctgagtgttgttctggcaagggtaaacgacatggcacactggtgggcatgtcttatggaaagctactcatgccccatcccaatatttacagatgtgaacatctgtaaacattctttctgcaaatacatcctgcaattgtatttagttggtcctcaatttcatctaatgtctgagtcctgtctctgcagttaagtcctgcctcctgagtcaagtcccacctcctacctcaatttgagtttaagttgaaaaaacaaattttgcagaagtgaaggcaaaaaatgaaggcatatccaaatgatacaaatgacaatcattgtcaattaatcttctgtttttataagggcaaatatgattccagaagctcagcattattttggcataatgggaactgtaggaaaggcagatgatttccatagtatttatcactgcattccttgctgtgtatttcaaattctcttggagtttgtacttctaaattttagaaaaagttgtgaattttgaaattttttcagaaattggaaaatatttgtagatcaaattaaacagaaagccaatgagatatattcacatctgtaaacattcttttttatttcaaatatattttgttagctaaaaagtactcctgttgttatattatttagttttacaaccatttttctaattataacaaaaatgtatttctgcaacagtgatatatgtgtttatattaagagaaaataaatgtaatcttcttgtaaacattttattttgaaacaccggtctaacatctgtaaaccaaggcagtattatgtttccatatacttaagaataggtactcccagtgggagatgatataggatagaatggaaaatgtattatccattggaaagattctgttatgtgggcatgtcaaggttattttctaaacatttgtgtcacatccttcaaaaattcttatttttttcttttatttttataattgcaacttttattttagatacagaggacacgtgcagatctgttacatgggtatatttgtgacatttgttcagtggtagatacaaatagttttaattgtaactgaagtttggggtatgatcctgtcacccaggtattgagaatagtgtccaataggtagtttttcacccattgcctgtctccattccttccccttctagtagttcacattgtctattattcccatctttatgaccatgtatactcaaagtttagctctcagtcatcagtgagaacatacagtatttggccttctgttcttgcattaattcaccgaggattatggcctccagctgcatgcatgttgctgcaaaggacatgattttgttctttttttggcatcatagtattccaaggtatatatgcaccatattttctttatctgttccaccattgattggcatctgtgttgattctatgtctttgctattgtgaacagcactgtgatgaatgtatgaatgcatgtgtctttttggtagaatgatttattttcttttggacatatacccaataatgggattgctgggttgaaaggtagctctgtttttaagttttttgagtaatctccaaatggctttccacagtggctgaaatattaataatttacattctcacgaacagtgtataagcattcctatttctcccgagcctcaccagcatcattgttttttgtctgtttaataatcaccgttctgacgggtgtgagatggtatcttattgtggttttgatttacatttctctgatgactagtggtgatgaacattttttcatattcattgtctgcgtgtatgtcttcttttgagaagtatcggttcatgtcctttgcccactttttaatggaatcatttgtttattgcttgttgatttattttagttccttatggattctggattttagacctttgttggatgcagtttgtgaatgttttcttctattctgtaggttgtctgtttactctgtcgatagtttctttaatttggtcctacttttattgcaattgcttttggggacttggccaaaattatttgccaaggtcaatgtcaagaagagtatttcctaggtttgtagtcgaaggtcttatatttaaatctttaattaatcttgggttgatttttatatatggtgaaaggtaggagtatggttttattcttctgcacatggctagccagttatccctgcaccatttcttgaatagagagtccctttcccatggcttgtttttgtcagctttgttgaagatcagatggttttaggtgtgtggttttatttatgggttctttattctgttccattgatctatgtgtctatttttgtatcagtaccatgctgttttgattattgcagccttatagtttagtttgaagccaggtagtgtgatgcctcaagctttgttctttttgcttatgatcactttggctctctgggctccaaaatctaatacacttttctatgtctagtagggactaactctctgcccagagtttaatcatgaaattagtgagccagtgttactaatagaaatatgacctatctctcagacataatagggcataaaaacttcagcggctgaaaaatcatctgaaagactttttaaaaatgtacaatctgagccatttttttctgatttactgtatcaaaaactctagagttggatctagaattcagtatttttagcaagcacttgaagtaatgtttctaaacactaaaatttcaaagcaataactccttaataaatgacaccacttttacatacatttatgactatagttgtaagtatgcgtaataaacattcaatctcaataatatccaaaaatgcaagaacataaagatcttctacaatgaaagacacattaaaacttataatgcaagacatagaaagattctcactaccataacctttcaggagaaagttttttgctgccttttcctcagaaatttagaatcactatgatattttgaaatctttatgaacctcaagatgtttacttttagatcttgttttaaacatactaccaattataagattgtttatattaaatgataattttaaaggatcaggaatgtgataatattgtcaagtattggggggaaattgccctaaatagcattataaataaatcatccaatcatcagtgttactcaaagttcattctttggaaccctattaccttcagatacagtacgaactaaaagcattattgttatcaaataggtgtgagaaatgatgcattgtatagcacatctgattgcagtgaatcacaatgcacaataacatatctaaggctctggagaggtcttacaagtgctcaaccttcccaatacagtttagcccaactaatacatagtaatatattgagaagaaatatacatttggatatactaatttatatgactcgtacaattggtccctttaaattggcaatcaacatatactttattaaattatactacttccaagttctgaaagttatttttaataatagagtctctactatacaaatctaactggttatgtctaggaaaatttagccatcttgtctttttgtaaataattgtgaataaaaattcattttataaaatgtaaataataccaatgagtattataaagtaccaaacaaaaaaaagacatgcaaaatcttttatactttattttaaaataatttttgagtacgtactatgtctgccagaaaatgtgcaagattctgtggaaattgatcaatagtagatatacgtcctgccctccttgaggttatgatatcatagagaagataaatgttaagatactattaggcatatgttgaatgctagctaaaaaagtggcgggtgctatagaaactgcattagtcaaagttctacagaaaaacagaacatacacacacataaagaaatttaatttaaaggattggctcacacaattatagggacttcggaaagtctcaatctgtaagcaagccagcaggctggcaactccggcaggggaatgctacagtattgaggaagaatttcttttctgagaaatcttagattttgctctcaatgcctttcaactgattggtcgaagctcatccacatcatcaaggacaatctcctttacttaaagtcagttgattgtagatgttagccacacatacaaaatagcttcaagcatcacctagatttgtgtttgattaaatagctgggtactaacctagccagattgatacataaaactaactatcacagcaatatataagggggcatatataaaacagttaatcaatcaaactgggaagctcaagataggttttatttaaaaatcgaattgaatttaactgagacttgaaataaaaatagagttaggtaaaaattaagggtaaattatagggtaaggtaggatcaagaagacaaaaaatcttatatagaaatattcaaacatgaaaagaatagtgctgattattttgtttctttcttttatataggaagcacaaaaaaaggaaggagtcaaggatgattttttgattccacagagtgagttatagaaccacaaaaaggaaaatagtagagaaaaatcgtagtttcagtttggggtctgttaactttgaaatacctatgagccctccacacagagatatctagtaagaatataagaatatgggcctagagagattaggtttggtgttgttaactcaagtaatctaaatcttgggaatagatgaaatcacctggggaagtgtagggtgaagagacaggtatttagtcagtgacctgtggcacttaattcaccaagatttaataggaaaataacccaaaaaaggagattgagagagcagccaaatacataggtaatgtggagtgtgatatcagggaaaccaagaaaagggcttgttgtaagaaaagtgttgtgatcaagaatgttacgtcctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctgtctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagggaaaggtagcaagatccgacatttcaggaaaatggaaagtgtttaaagatctacagtgagaaattggagatgaactcactgggtaacagtaaacatagggcaattttgaacactcagtggaacttggagaccactgaagaaatttatcttctgttatgtaatatatttttctcagtggaattgagtagcttatatatactcatggaataaatggctatattttttccagattgtttagatgagtgtgacaacaggataacaaagctgaggaatttaggttactggaaaaaaagggcagtttaaagtgttctgtgcatctgggtgtggtggctcatgcctgtaaacccagcactttgtgggcctgaggagagaagatcacttgaacccagcagttcgagaccagctgggcaacatggagaaatcgtgtctctataaaaatattagccaggcatggtaacacacttgcattcccagctatttgggaggctgaggcaggatgattgattgagcccaggagtttgaggctgcagtgagctatgatcatgccaccactgcactccaacctaggtgacaaagagacatcctgtttcttaaaagaaaaaaaatggtctgtggaatatggatttagaatagaggtaagtgacattagaaaatagaggaggcatagggaagagaaaaatgtctggtggacagaaatttcattgtttaaaaaaaaaaaacaactgtagtgggataaaccaaatagataagtaagaggacagaatttgtagttgtgcagtagaatgacttactgaagagtgggggaatagtggaatagtggaatagtggaatggaggaaaattttgcagaagacaaagaagttaagcctttaactagctgtccatgtgtacatgtaattgtcatggtatcaaataaaaaattggagtggaaaacatgatgacacaggtactaatgacttaaatgagtgaggaagtaaccaggcaagtaggcagtgacagtaatgaagtgacaaaggaatttataaagccatatgatgtgaactaaataggagagggatttattattttttttttacaagagaggctataataggaaataaatagaatgtagtatatacctatttattagtggctatgttatgttatgttatgttatgttatgttatgttatgttatgttatgagtctgagtcttctgtgaaccagatgccaagatggaattagaagagccaagatttattgggaactatctatgggggataaagaagaaggggaggaagcagaagtaggcaaagaatgccttcagacagcaattcagccctgacatgtgtgaaaggagataaggaaggaagggatatttggtaggaaactcatgactacgtgggcattctgcaaaagcctcagccagaccaatgtggagtccccaggcaaatgtttctccttggaaaaatcccacatcaggcaggcatggcccagatttatagacctcaccatatttagtcattggctgtgagcagagcataggatgtgtggctttggagtaaaagccattgtggaccccaaggtgctggaggctgtcggccaactctgcttccacggaggattttctggaagggagattttagtggaagacttctaaaacctgcgtgcttcatcttctcaggcatcccacctcttccacacaatcctctaagccttttttgaccgcacttattttatttggtttgttttgctttctttcctagaaatactctatttagaaaatgacacctactaaataaagctcctcgagaaactttcctggaggtggactatatgacaaacatacttgaaatggactgaacaaagttattcttgtgagttagatgcagcaatccatatgcttacttgtagaagaaaaaaagtggtttaaattataatctggatgtaaaaaatcttaaaatcatgatggttacattcctgcctgataggaggtttttttctgagccccacatatttctatagtcagagactaagtccataagcctagcttccaggtggcttctgatcttcatgcagagtatggcttggatatcagtgtgttatggatcaaatttgatgggttaaaagtctgtatatcacaggtgtttcaagattaaaggcaggggagtggtctcttcatcagggaactgagagttgttatatgcacttaattatacatttctatatgtaattataaagagttttaagaatagtatatgcacatctctgccatggatgatctggaactttaaaaatggcatttgttatgaaatgactaaatatagtaatataattgctattgagttgtccttttcttgactgtcaggcagtaacctcatcatatcatttaattctgattggcagctgtttggtactattcatcttacttttttctccttgaacattactcactttgtaatcattgtatctttaatatcttgtgtcatacatttgaagcaatctggcagtttctgacagaaagaagttagaaaataaaagccaacttccctgtgtttttttctggtagaattgctgatatacctacaaccatagaaatattatgaaaaagtagttgaattaaacaatgtcagtgggttataaataataattggctcacttttataaaagctatgtatataatatttagaattatttgctaatgatcagttttctattcaatagaaaagctgtatttatttactaacaataaataaatgacaattattttgcagcataagctgctgtctctaaatctcccctctcccccagtttctaatactacttaatggcagacaaatggatatatttctcaactgctattttattcctatctccatatgttatcctaatcatgagccacaataccccactttccatggtcagttttggataacatatcttattttcaaccaattagtgtatccagttatcatataaaccgttttttgcatagtaaaaaacaaacaggaacaagccagttttatgctcccaaattcagttaatatgatagcaaacaaagggtaagagaaagcaagaaagttttaggactgaaagattgttggaaaaataggaagtagtagtcagagagtggactacaggaaactattatggaagagttgcagtttttagtaatggcaatgctcaggttatgacctgataacatgagattttaaagcatgttagagtttagagatgaacagaggaaaatggtgtgaaaagggcaatgatagaaaaagagagtcaatatcccatgatattgaaacaaatagctaccgctgcaaaggatggtggaggaagcaccaccttcaggacttatctgttaaaggtggaaggtgagtagaatgttcacagaagagattgagcatgaaaggacatttgctgaatgccagagggcaccctggaaaacttgtgagtgttggagtataagcagaggtgggtaagaagaaatggctccctcttaatccctcttgatggaggtgaggttgtccagggttcactttggattgctgtgggaggaatgtgcaagagctctaacttggtaggtaaagtctattggtgaagctagttcttctagcatgcacacccccttcatcttggtgatagagggacacgaaaaagtgtaatttgtctaagttagacattttctatatgttaagcccataaatattttaccttctctttattcactcatcaaatattcattgagttgctgctcagcatcaggtgcagcagcgagcgcttagtctctgtcctcctgctgcagcagagagtacggtatgggaaagagacagagccagttatttcacaagcaagaaccaattaaagctgtggcgatttctgtggtggagaagtgcatttggcaggaaagtatgtaactggaggcttagatttgcttcagttgtcagaggggcttctttgaaggagtgacatttaacattttttcgaaaggatgctggtgagcgggtgaggaaacatgtcagacagaaggaaatgaatggataaggatctgaagcctgcattctacatagtgctcttccactccctgttatatcccataccctcccaaaacacagagcttctgaggctgttcaaagagcaaatatttttggaaatctttaaagataatttgaaaagtacaaatgattctttccagtgggatgaaggaagaatgttttaccattttacttatccaactgcttttcttgagtctgagagaagagggagagctcttttttgagggaagcaatattttagagatctatcagtagaattggagtttcttagatttataaagtattttttgttagtgtcagaagaatttgaaaagcaggggaggaatataagagcagtattatggctaacttaagactttttacaacctttgctcttatctctataataaattgtacaaccaacaatctttaaactattagtaagtcagtagtatttcctatttcattactatgtgccaccaaactatgcacatttctttggtcagaactttttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaacttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaagtttataaatatatttatcttttttgggcatgaaggacttaaatttttctctttgtataatactattttaacaaaaatattctgatatgcttcttagtttatgaattgatctaaatgaaatcatgatataaggcagttttacattttagatgcctgggataaaccagctgagatccttcacttggaggtacagggatgtggcaatttaaaaggtaatacagtgcattgattgtatcatcttcatcattcagcccaaagatcaactgagcatcctcactatccagagtctactaaacactaatagtcaagttaaagagataaattatcttttaattcaaagattttacaatttagtaaaggtttcagctatgtaatacagtggtattaggaaaaaagaaagttagtacaacgatgacgcactttttctaggaattcaaaaaatgatggttaaatacaaaatgggaaatcaagaaaggagggagatggggacagaattacagagcatctattatttgaacaaggccttgcatgagagaaaagtttttaagggaagaaaaaatggaaaagaaagtgctttctcttcctctgagataaaatgggcaaaggagaagaaagtggaggtaaaaaaaaagtatatttcaagttgaagatgagaaagtacaattctcttggatggccttgattttcttagttgagcagatgaaagatagaagtgcatggttaggcaaaatgagaaagaaaatcaaaggtagaataattagatggatgcatagctggttagatagatgggaggaaaaatatagaaaatataaaaaacaaacactttttgaataattagtccctgccaggcactatattttcacattcgctatttgaagccaaatatgaagaacacagtgatactagaatcttacaatttgtggtggagctagggaaatccacttatatcaatttgtcatcaaacttcagcaaatagaattggtgggtggtctttttaatccttaacttttgtggttgcagatatcttgagtatagtcttttccttttagaaggcaaatactgtaattttcatgtctgtctcccatgtctttctctaattacttcattacctgaatggtctcttcagaaatataattttctggtaaaaataaaattatatggagttaagtgacaactctgtgctttttgtatatgcagccactctatcatgcagatatggtagttaagttgctcagttttaatttggggcaatagactgagcagccatttaagaagctgaagagtagcttctctttttcggttttgtgtgaatcgtgggtgtaatttaaaaggcaaaaatggagaaagcctttctggtcctggatagtgaagcttacaggaataagaagagaaaaattgaatttaaaaacaacaacaacaaaacatctgtttcctcagaattagctgctactacccccttcttctttttttttttttcaatgtgtacgagaatccagaatttcttcagtgccacaactgaaacaaaaggtgtctggattagacataagtgtagactacagcaaaatgcttcaaaagatccaagtggcaccacttacataagccctcaggtacccgttaccttacaggatgaatggcatctcattgcagcatgtaagaacttagagacagcatgggagccaaacatggtttggctcctctctttacttccacaaaggtaaatcagcttctttctatactctgattctatatttggaaaaaggaggaacagggaagttcccttagaggggaaaaacatgcctaaaagatggaatccatatattcatttttcctaattttcacctgctatgaatgaagtaatgtctttattttagcaaaattatccatttggacaataaatggccaccttattatcaacgagcttgaactttcaattgatttaatatgtacagtaaactgacagttttaaattggaagataataaacttggcaagtctactcagcaatttgcctttggttggttttctatccctactcccaaattccctacacatgccccattatcattggaaataaaaatttccagagcaaaatgaagttagttagagaaaatgatggttgtttttgcatgttagtttaagcatttaatcttaattctgccataccaatcttgagtagacaggtctgtgtgtaatacaagcagagtattgccacaatgtctctaatcaccggttttttattcacattggtgaatgtcatcaacttttagatcatccaccaaaaatccttagtgtaactgcaaacctagagtttttctctattttacaaacacactaatacatgtcctcatgttttattgaatttctaatgttaaatgacccattggcatatattattatctgggatagaaaatatataactcaatgataaaaatatattttaatggcagatttacttggtattcctcttacatttcatacaaggtatgcacaaaacagaaattttaacttttctcacctgaaatatctacaatttcttatcaatctcaaagaaaatacattatgtttgaatagggttgtcctaggaatgtacagaaaccatgtatttctaatcccttaaactaggtttgttgactttttggaaaccttagacttccaatacttaaaattcatacactggtctttacttttagaaaacaaatttgagaatcaccatatatatatttttgaaaattttggaaatatgtttgcttatagcaaggtaggaaaatagattgcttatagcataaacatcgttgacatttattttgaagaaaaaaagcaaactaagtaatttcacagacagaacaaagccaggctttcaaaaaaacttatgtgctctacatatactacagctacatgaaagtaacttgtaataagttttaatattcacatgtcaaatggataaaataattaaaaattctcaaaatattaaattattaatttatgaattaccttataagtgcttatttaatgggaaaagaccagcactttgaacctagagctttggcccatgttcaatttaaatgataacctgtgattctaaactagagggtttaacatccccagtagaaaggtcaatgggaaatgtaggaaatgagattttttttcagtcaccctaaggaattcttaactaccttgcttgggtataagataagtgtctgacaaggaaagaattgtcccctcaaaaaatccatctttattagcatccccgttgactggaacttaattaaatttatttatacttgctggacacaactgaacatctaagattccttccagctctgaaatactccgcaacagttacttaggaagaattaaactgatgcagttactctagtagaatcagatatacttgtggtttatatgtgcaggaatacacattaaaacacacacacacacacacacacacacacacacacacacacacccttcaactttaacagcatcttttctgtaaaggaagtcagtaaaaggctgctctatttcagaatcaatctaaagagagttatgcaagtaaaaatggtcttttcataacattttttcaggaagatgatccctatatcggaccccaataatgaaattaaactacattttagtacagcaattacaaaacatcttttttctttatagaagcaatgcatgctttttaaaataaaatagtaatacatagatagccaatatatacagtgaatgtaagttgagttcttcaatgccccatgatctgctccttcttcacatcttatcttcctctctggtggaaccccagagacttctttgttaaacccaaggcttcacataacacagtggaaaacttattgctataaattagacataactaacctcggttaatagagaataagcaattgaagtagattgtgccagtcctggacaatcagtagtggtagaattgaagtaaatttaaaacttcataccattccctcaaggattaaaattcaatgaaaaaaaagtaggccaaagaaaacacttctataaattatattttgtccttgaggggtatttttgtattgtattctaggctacatgctgttacatcattaaaggaaactttgtttattctttctaactagaacatttatcccagaagccagcaagcacctcaatattaggtcttataatatgataaagtttcacctccttttatcaatgtagagaagtagtttcttatcttccctggtgacattctggcttttggcatccttcttgaatatagggtataaagtctccttttgatttgaagaacttgtgccttctgatatatccctgcaagtttgggaccatatttggtatgcattgtgtgtaagctttgcttagtgaagcacagtttgtccataaacgaggctcatccttaccagacaaactctgggattataaatacacataatactcttagcccttagtaatagaggtcaaaagataatcactgggtgggataaaatgtgaaggtataatccagaatagtcttaaaagaaggttcttagaatagttgcagataatatacattgtagtagaagggtgtggaaaataaaattaagaaagaaagtaataataaaatagagaaaatggtgaatggaagtcaatgataaggtaaacatatctggaaattaattcatgtcaaattttgtgtatatataatattttcccctcattacaaaattatgccatatacctttctaaaaagagaaaataatataatgtaatatattgtaaaactcattgcatattttgtcctgatgctattaaaaagtatttcccacctaaagtttatgccacatgcattttatactatgagaaactgcatttgaatataaatttatgcacttttatctcaatgtctggatttcaacctcttgcaaattagcaattaaattgaactagatgcactcgtgatgtgatttaaatgccatttgactctttcagagcactcataaatatgattttattttcatggattataatgataaatcccccaaatgtagacttattttttatttcttcaagtaacaaaggaatatagaatttagaattatgaataatggagatttattcttaaagtattcttttaattttacattcattatattttgtgtatgtgagagagttatacttcacactcagaaaaagtgatatagctactagttaatgtggtagtgtgattttactagttactttacctgagctagccaaacattactcagttttcatattttcttctgcatagtttgaacgtgacagctctcttttttaattgcattagctttgacagtcataaggagatgaaagcattttaaatgataccataatgaaaaatacagaggtttgtttgctttttctattaggtatggttgagcataaaaactcatattttcagttttgttttgatgcattggtacttcacttccttgcatgaactgacggaactgtggaagagtattatgtctacacctgattatgagtatcggcaccagacaattagtaaagcttcattctattacagttcatgcctgaaacagtccccagcactcactggttgactaagtgaacctttcaaaaacagaagttcattacaaagatgaaaaacatttaaaagctaatcttagttttaaaactggccggggacagtggttcatgtctgtaatcccactactttgagaggcaaagccaggaggattgcttgaggctaggtgttcaagatcagccttgacaaaacagtgagaccccagctatattaaaaaataaaataaaattagctgagtctggtggcacgcaactgtagacttagctacttaggaggctaaggcaggaggattgcttgggcccaggagttcaaatttgcaatgagctatgatcatatgatcaatccacggcacttcagcctgggtgacagagaaaggcattgtctctgaaataaataaataaaaataaaaaagaaccttagtctacatatccctacaagagatgaatattatcattccctttatactaatttttgggaacaattttttgtgtggacggcattggtgaaaaaacacttgtggctacattttacattggttctttagaatcatagcaaataaattctaatagtatgcaaacaaaacgaaaacaaagaagtagtaatcctttattaatcacatagttttgctttagtaatttctatcatgttttatttgcaagcataatgcagttatatctttgatctttttaatagtaagttcgctttctgtaaaagtaatgaaaatttaactgccttttcaattcttattaggtgtatgatatttaatttaaacatataggattaattaaatatatactaagcctattaatgacatcctattaaacactattagcttcctgtattacaattaattagatgtatactaattattaagacaataatatataagtatatagttatatttaattatattaatcaatttatggaaatttaaatttatgaatttatattttaatatcttcattttttaaactagtaattatagatttgtaacatttgtaatatgtgtaggtaatcaacataaatacaatttctataacttttctctgtttctaacagatttaaattttttcatttgatttacattcatttttctgaaatagtagcattaatttctcttttttcctgagcttagactcctcaatacccctatttatagattccaagtccataacgtgttaccttggaaactatttaaagagcatcgtctctttactatttgtttttatcggatcataaaactgccttttttctccttcagctactgcttcaaataactcagtactgtgagaactgataagctcagggcttatgccagtattatagtgtgtgtgtgtgtgtgtgtgtgtgtgtgtgtgtgtgtgtgtgcgcgcgcgcgcgcgcgcgcgcgtgcgcgcacatgcaagagcattctcatgagtatgtgtagatatatgtgtgtttatgttttgtgagtgactactaaaaattaatcattatgtcttatacatttcctcacaccattatgattttgggggactacctgtgtgttgaaaaactggtttttgaaatgacttcttgtatgaatagtctaatatctgaatctgtagtatgtagtattttaccagtacaagatatatagcattgtaatactttatctcaggcagtctgaggttatttttagctctaattttctctataaaaggcagcacaatacagtgacaaagaatattagctctggggctgcactgcctaaattgaattctggttcaccacatactagttgtttgaccttggacaagctacttaatgctctgtgacttatctgtaaaatggggttaataaaagtgcttgcctcataggcttatcagtcaattcttgtaagtacctagaatacgtggttaatggatgccaggggtctaaccaactggcttgaaaaagattgatcttaaactttaattaatgcctgtggatatacactcctgatgatctaaagagaaatttaatttacatcaacaaattcacagtctgggtgttaaatgtgaataaaatcaaatagttaactgcataaatactatagatttcaagatttatttttcagtccaaattttgaagtcaaagtataatgaatttataccagaccctcaggaagttattagcatagtgtctggcatatgataaagtctcaataaagagtgaaattaataatcattgtgtgattgagactcactagcactagtaattaggatgataatatcacatggaggaaaactatcagagtccatacttgttatttttgtcaatcttgttctattatgaatcagtaagagcaacttatggaatgaccattcatgctttagcatgtgcatcttaacatctatagaatctttccatgatatgttttgttgtaaataaatatttattgacataatttattatttacttgtaataaggcatttagtatgcatatttactattgaaatgaagcaacattagggttttaaaatgttcctttataccagaccctcaggaggttattaattatttttggatatccttgcaaatagtccacttcacagtaattcacactggttttgatattttaagattcttactgtacgaaaggtatttattaattaagttagagtctttgagtatctcatctgcattatggattcagatatgcttgcccggataaagcattagatttttaaattcttcatgtcacttaggacatttttacttgatatcactttttaaggtgaattcatttgtaggaaaaaaagcaaatgaaaagcagaaaaattagttagttaattagcttgggattagccatggattttgtccatatgagaaaattcagtgaccttaagtaatgatttattttataagaactcacagacctttatttattactatgttacattgtaaaaatgcttcacctgagccttggtttcttcaatacaccatggagctaaaaagttttattttgcaggattctgtatatattgcagttttattataaagcacacttaaagaaggctaataaactcctcattgatatgcaataaatattagtttctctatttcctttgtggaaaccatgaaattatatatatatataatttttgaacacttttatcaaattaatttttaaaagcactcatttactaaatatgactacagtggaaagaaggacttaatagtaatttagattatgcttcatcaatcattagaggaaatgtgagattggatcaaagaaacaagtcatcttccaagaatagttgctctgaaactgtcattttttatttcagtgtgaatattacattgagtaattgcagtatattttgttctgtgtggcccctaacatttgcattccctcttattgggaggaaagatttattgctgccaccctaatagtacagtgagtctttattcagtgagtgttcactgtacaccaggcactgtgttagccactttacaggcattttttcttacaattcttacaaccaacttgcaatgtgagcattcctattatccacattcacatttaagcataaagaagttaaggtttatgggatgtaaagacttgcccaaagtcatacagatttaaaatgccagacccagtatttgaactcaggccttatttcagagcctctagtccatgcctctatgtactatatctctgttcattttctcactccaatttccacttaatattttgttctttgaaactaatgaatgaacctcatcacttgtaactgcacactttgaagcctgaatatctctggggcaggaaatgaaaacttagcatgagagagacagaacatgctatgaaaatgtaagtctgtgtgtcatgtcaggcaacttcatgagcagcaattccttcaaaattcttattctaatttcattaagggaagtgaaagggaggattttgagggtgcttctagttttcagctggtgccttagtgtcttgttttggaaatcactttcttatgtctaaggaagtaaataatgaaaaattacaatggacataaataataagttaataggatcattgtggggatacttatttcattgtcattaatttcttaatttttttgaccttccttagagactatgtcataaaaaggaacattttaaaaccctaatgttgcttcatttcaatagtaaaggtgcatactaaatgccttattacaagtaaataataaattacatcaataaatatttatttaccacaaaagatatcatggaaagattctatagatgtaagatgcacatgctaaagcatgaatggtcattttccataagctgctcttactgattcataatagaacaagctggacaaaaataacaagtatggattctgatagttttcctccatgtgatactatcatcccagtttctaatgctagtgagtctcaatcacacaatgattattaatttcactctttattgagactttatcgtatgccagacactatgataaatagcttacacataaattatttttttcagctcttcattcccatttcagaagtgaggaaatttaagcttgaagaagtttagtaacttgttcagtgacaggcaagtaatagtatgaagttggaatgtctgactccaaagcctagtatcttatttgctatgtttttttttttacaatttgttgcatattttcttttgttttgtaaataataatattgaaaaatatgaaacacaaataaatagaagtgtttgttgtatagctttttataagactaggtttttatgttagcaaaataaatataatattaaaaagaaaatattttacacctttaatgtaccaatggaaaattctttcaaaaaaattcagaaaattatagccaattgccccctaattatctgtggtgtttaattcaatgcctaatctattatctgtgaaatagaaaaaacaaaaatactttcatattcataattagactttagtactcagtagtaagaaaaaagaaaatattgcatatatgattctgttgttgttggtagcagcatgcaaatttctgcataccttgtttataactgacattaaaagttctatgttttcctcttgcttctttagcaaccatatcaacatgcttttggggaataagaaatgccaagttatatcatgtatgacagagttttcctggaaatatttgtacatgtgaagcatactatatatgtcatggggaaaaagaggatatatgtaaatgtatagctttacgtttctggtactgagcttggaaaaatggtagaagttttcagggatgccatttagtgttggattgctgcacagtgtatttgcattatttgcaataactgaagtatttagtatttgtgcaggcatccttgtatttaatattgttaatatttatgttaattaagagagaactataaagaagcagatcagtcagttgcagaaatcatctgtaaacagcttttctacaaaggttcaggatgttgctcccaaggaaagacaccgttacatgacctctgattaatctcttccctcttatttgatttctttgaataaatagattgctctacgttctcaaagtaaaaagggtgatatattctaatattgctgtaccattttaaattgcatagataaaagcctatttagtggggcataagatcaccataagcctcttggcagttttcagcgaattcatacatatcaaaagggactcaaagaaaaataacaaagagcaaaaataatgagcccgtcaaagcaaatgcttaatgcagctccactttggtattaatcagactgtatgtgggtgagggtcaaaccaaccgaggtcaatagagaggattttggtaaagacgaaaaaagaactaagctagtgatttcagacagattgaattttttttaaagtgaaataggaaggtcacaaaatcagattcagtttgcagaagcacagtgggcaagttttaatgacttctcagtagagctttttaagagaggcacttgagtttgaactatctaaactaaacttttaaaaaatcaacaggaaaagggaaggaatatttgtaaagattaaataaacttataaaacttgcttttattgaagaatttcactactttggaagattaaagtagcttccttaaaaaggagattttaaatgtgtgcagattttatttaacacataatttagatattgctttatgtcacagaagagcagtatgtgcatatgtgtgcacatataattgtaaagatgtctttataagatactttccataattaaatataggtgatttgaatatttataagactttaaaaatgtttctgtaaattgtatattctgagcttgctaaatccctctttgacaaatcctgaatgggagagagccaataacattcttttcctctatcaaaccattcttactctacatattcttcttctgctttctagcagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactctattttctcaaagtaaaaaggaagatatatttacttacttgccaattatcttattgaagtgttaaagttttatttttctctggattattttaagatgtacttactattaattcattttattgaaagttgacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagcaaataatgtatttgctctattatttaatataaataggtacattgatatatattatacacacatatattaatatacattgtatacaaatatgaatatatacattataaacaaatgtatatatctatatatacattacatacaatgtatatacatacatatatacaaatgtgtatataaatatatacattatatacagatatatacattaatatacattatatacaaatacatacattataaatgaatgtatacatatatacattctactggcaaatattacattctgtccattcataatgccacccattacttcactcaagcatcctagattattgtataattggactttatgccaatagtcattcctaatctctccatgatacgaagttcaacatctgcttttttaggttccaaatgataggacctttaactacatttctagcctcattttatcttcctttgtatttttagtacataatgttatacatagcagtgttcattaaatgaaataattcataacaaatgaaatgataaatctttttcatgcatatgtatggttttcaagcaataatagtgaataatttgtttttctcttgctcctgaattataaaaattatggtagaaatgaactagcattttaaatactttttttatatcacaaaaatgactgaattcttattaaattatgtgatttttaaactcacaataatcttggaaattagacacagcaagagttagtattctgacttataaaggggaaattttgtctaagatagataaaggggtttgtgcaggatttctcccctagcaaatgatgaactagcactggaatttaggattcctgaccatctgtgctttgtctttttccattagagctaggatgaacatatgccccattttttccagaaaatttcacttaatacatagcatcttgaattgataattaattgtgccctatttcactctcctgtcctggtttaaacaataaattatagggcaaccataactatagctcacagtaagaaataagagaaaaatagaagtaggctatacccaggataagtaattttgatatcaaggttgatcagatcatattaacttgttaccatcaaaatatgtcattttaatgattcacaagttggaaaacttaccttgtgaatattgatcactactgtgatatagattcttattattttatcttatttgaaaactactaaattgtctatgaatgtttctgagtgttgtctacacaaatttaagacactacactatgtgaaaatgaacccatggtagttccaaactactcaggtttgacatgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacattaatgatattgactctttcatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacctggagaaaattgtatctgacaatcctattatagaatgcaaaagacaggaatgaaaaatctatggtcatacctattcacaaaattgtttaagtctagtttaaacaacatactaacatcactattatttctatataatcccaataactatttgggcttaaaatttatacaattctatttagataaattcatagtatgctagaaatgaagatatttcaaggagaatataagaacggcaaggtctttgtagcatcactgcatgtgactggactaaaaatccaccgtgagcttgctgagtaaattgtttcagatttgatcccttcaagtgttattgaagattctcccacatataataccttaatgttactcaattcattgttctaaggttgttctaaaattgttctaaatttctggctatgccgaagttcatttctaaaataaaaggtaatgcaggcagttaacattttgataaatactacttcatacttttgatctcatttcctgttttttattacattagattttctatcaaaagaggccattatagtttagggataaatgcttgacaacagagtgtgtatgtcaggatatttcaaacggtgaagaaataatgtttttaactactttaattatgcttctttctttcctattggatttgataatcatggccaaattattcattaattacttttacagataaccaaaaaaatgccaaaaagtgctgtttctactaaaatctcttagcaggaggatcttcatgtttggattgtgcacaaaggtattttcatttgttcagagcacttaaacaaaatggacaaaatgtgtattttttagaaaattacccatatatgacagagcatcaccagtgacaaacacgttattgctgaagagtagacgtattttgcatctgcttatgtcttaatctgatgtactttattcaagaagcaggaagtgagggacagagtcctgtagttggccttaaaatcctgccccacaggtctgtgccccttacacttactcaccaaggcttggccgtgggtttgttatattgaatcactacttagaaacttagtttcctccaccattggccaattttcatgaatgttgtcaatgatagaatttctcgatttttcagatatctcaaatggctttaagccctggatgtaactcaattaaaaatattactttcagttatgttgttatctgttcacatttgagctgctgataacatctgttatttgagttgttaaaaaataattatttgttgatactcttttccatgctattttacagaaacgtgtaacttgttaaaagtgttagttctatcttttttctctgtaaaaagtagaattctaagaaaaaaattacaataaccaactaaggtaaagaataattaagtttgcttttgtttcttttatttataggtatagtgagttggattaatctcactcctaagttgcactattattagtctatgcaaggtctttcttttttatttgaaaaatagttttaaaaattttaattattaccttctcagccccattgagacccatgcccccactatctttacgtaatgaaccactctaacgtacattagtgtatgtcctttatcatggttatatcctcaaagaatatatgctggtacttttaatatgcatctttggtatttttaaattttaaatgtatatatttgttttagttttcactcaatgtgattattaattgttaattgtttctaatccacaagttttatacagtacctgctcatcacatagtatttatttcctagtgatggaaacttcattgacttcaacttcctgctgtcagaaactatcctttaataagagtcaccacacagtgttaattcattcctaatcaatttgtggtgccagttaatgtgtcaaagtatctgtctgtctatatttgtctattatctatcatctatatatcatctacattgatctgttttccaaagtcttaattacattctattgattttttttctatttagctccacttatttttactaaaaattttagtaggatatttaatattgactaattcctcttttttcttctttttcaaaatttgctcttctatggaagtttattatgatatgtaaactttggaatacatttgccaagtaactaaaaaaatctgctttatttttagctttcagatttattgagataaagttgacatacaataaacttcacaagtttaaaatgtaaatttgaaatttttaacatacgtatacatcagcgagaaaataccacagtgaagatagtgagcatatctatccactcccaaaagcttccttgtatcccttggtaatatggaccacacaccttttctcaatactgctcctaatcataggcaactactgatctgctttttgtcagtacagattagtttgcattttctaaaattttatataaatcaaattgtatagtgagccacaatttaaaacttatgaattgttagtttctgaaattttccatttagtatttgtggaccacagttgactgcaggtaaccatgtaacagcagataaaggaacattactgtgtgtactcaatttgtgctcctttttgtctttcttttttcattttgcttaaatattttagatttatctatgctactttatcttagtctatgacttgtcttttgatcctcttaaaagtggctctggaatagcggaatcactcaagtttaatgaaacctgatttatgtagggtttttttgctgtttcggattgtgtttttgttgtcttatttaggaaatatttgccatattcaaacccacaacaatttcctgctatattttcttctagaagttttatagggttaggcttaaaaatggttctaagattcattttgagttaattttttgtacacgataaaggtatagatgaaagtttttgcttaattttccttaatgtataatgttacatgacagtatttattttgaaaagattatcctttcttcactgaatttcctttgcatttagtttaaatcacttgagcgtatatgtgtgagtttttcttttttcttttctttttttttttttttttttgagttggagtctcgttctgtctcctaggctggagtgcagtggcatgatcttggctcactgcaacctccgcctccttggttgaagcgattctcctgcctcagcttcccaagtagttgggattacaggcgtgtgccaccacacctggctaactttggtgtttttagtagagactaggtttcaccatgtttgccaggctggtctcaaactcctgacctcaggtgatccgcctgcctcagcctcccaaagtggggtttttctttaatctgctgcatttttctataacaatactacactgtcttgttgactgtaggtttgtaataattattgaagtcaggtagtatatatccttcaactttttttctttttcaaaactgttttcactattctagatattttgcatttctatgtaaactttagagtcagcaagccaaattctataaaaatacttgctgaaaatttcattggaatgtcattgaatttatagatcatttggggaataattgacatcttaaaaattgataattttactatataaacagactgtatttcatcattaatgtttaatttctcttagtaatacttttttagttttcagtttccagatcttacacaaattttccagctatcctcaagtatttcataattttgatgctattgtaaatggtattttcaaaaacttcacttttgtagaaacacaattgattgttaatagtgatcttgtatcctgagacatgtgttaagctctcttattagttcaagaagatttttcttttttttgtagagtaatatgttgtctatggaaaaaaaaggttttcctcttccccaccaatccaaatgactatataagttttttgtgccttactgtattgactggaaacttgactaggaatagtaagaaaagatgtattttccttttttcctatcaaaggggaaaacattcatttttacataattaagtatattagcttcaggttgttataggtaacttatatcgggttggggaattttcctttcttctttactgaaatattcttttttagtgttttaaaatcaggaacaatagctcgatttatcttatactttttagaaatctattgggatgatcatttgtgtatatgatgaatgatattcttttttattctaatgttaaagcaaccttgtattcctgagataaactcaaattggtcttttttttgtatagtgttgaatctacttgttaacattttctgaaaaccttttacatctatgttcatgagggatattggtctaaagtttgcttctgttgtttgctagttctgttttcggttatgtttgttttatatcatgttaagaatattctatcctcaattttctggaatagtttatttaaattttttttaatgtttggtagaatttattatgatactgtgatatcacctgggcatagagttttctttgttgaaggctttttttttttttttttgatacggagggtacacatgcaggtctgttacatggaaatattgcttgaagctgaagtttagggtaatggtcctatcacctgggtagtgagcatagtacccaactacctgttggtactatgcctcctccctacctcacccctctggtagtccacagtgcctattgttcccatatttacatccaggggtgctcaatggttagttttcacttagaagtaagaacatgaggtatttggttttctgtttttaatgacaagttctgtttttcataactacaggattacttaggttatccatattatttttagtgagctttggtaatttgtgtctttcaaagtatttgtccatttatctatgctgttgaacttattggtttaatgttttttacaatgttgccttattagtatttttaaaaatatatctgtaaaatctacaatggtgtcacttctcgcattcctgctactggtaatttgtgtttctctcttttgtttctgatcaatctagtttaagcctgataaattttactgacattttgaaagagtcagatttagattttcattgattttctctatatgtctgttttctagttaatcattttccactataatctatattatgtcctttctctgcttactgttggtttcatttgtttttctttttctaattcttttttttctgatatcctgacattctttacctcatattatttccacttccaataaaatatataattgagctgaattttgaaaaaatatagatacttcaggatacttctaaatagtgagtgagtgaaagtcattatttgccataacataacataacattcaattagttaatcaaaaacccaaatgcccgctaggtgcccaacactgttccaggcattcttcttctttatttttttttttttttcattttactttaagttccgggatacatgtgcagaacgtgcatgtttgttacacaggtatacatgtgccatggtggtttgctgaacctatcaacctgtcatctaggttttaagcaccacatgcattaggtatttgtcccaatgctctccctctccttgttccccaccccccgacaggccccagtatgtgatgttcccctccctgtgtatatgtgttctcattgctcaactcccgcttatgaatgagaacatgcggtgtttggttttctgttcctctcttagtttgctgagaatgaaggtttccagcttcatccatgtccctgcaaaggacatgaactcattcttttttatgactacatagtattccatggtttatatgtgccacattttctttatccagtctatcattgatgggcatttgggttggttccaagtctttgccattgaatacttaagtggaagttgaagtactggatttgaatcttttcttatcttttccagtctggtcgtgtagtgctactgcttcacatagtgttactactgtacctaaaactgatatattttatatattttattttcattttcattcagatcagaatgcttttaaatttctcttttgattttttccttcacttgttatatgaaattgtgctattttctaagtaatcaatgattttctagctatctttctgttaatttgattgctaatttaattttatcagaaattaatttcaaagtttttcgactctttacttacaaggcttaatagttttaatatattttattaaaatgcatataagtttgttgagagtggatacctaaaaaaaagtgaacttatcttggaatgctattaatgtctatctccttcaggttttgtctaagccatttaaaagttttaaagctttcttctttattcctagatatttgataatttatattattatttatatgatactagccctattgatatttgattattactatttaggggaattattttgattttattggtctaccttctatcacaatgagcttgattttttaagctaaatgcctggattatgtgtgtgtgtatgtatgtgtgtgtatatatgtgtgtgtgtgtgtatatatatacatactatatatattatatatgtatgtagtatatgtgcatgtatatattatgtatatatttatgttatatatatgtatatatgtatattatacatattagcatatacatacacagtatatacacatatatgtatatataattatatacacatatgtgtgtatgtatggatatatgtttttagctatttttattgcattttaattctatttaatgagtcactgagaacatattatctgctcttgagtgttgcaatttattaatgctttcattgtattctttacaaggtctatttttgttaagtttacttatgctataaaattatttttggttattttgggtaatgtacattaacatattgaatacaataatcaaatatttgtacacttctttattgattccttcataattattcagtcactgaaagaacaatgataaaaaaaactctcattacaatcccacctattatcacagatgtattcatttttacctataatttcatcagttgttatttataaatatataaaaaggctacatttttagatatatatatagatttatacttgttatattctattcatctatgtttaaatattgcatggaatttgactttatcctttatgatttgtatacttaagttctatttttaattatacagtggcttgaataggattctttgattttaattgtcttatttaaattgcaatgcttttatttttaaactttctttgttcttctgattgtatctcttatagatttcagaaacctagaatattttttcttatccaatctgaagttagtgccttgatataagtttaacttagttgtattagctttaatgacatttgtgttatgatttactacagcttttccattttatattcatttgtttatcacaattccatttatcctatgtttattcatatatatgtatatttatatatgggataaatggaattgcacacatatacatatatgtgtgaataaacatgggacaaatggaatgcgagtgcatatatacacgcactcatgcttatgtttctattttgctatttacttcctggaatcatcttggaatcctctggctcactgatatcacaacacccaaaacacatatcatattgatattatataaatttcttgattgtaataaacatactacaatcattttaaaactttgtttcttatttatgttgatggcattaatctttaacaaataatttagtgattattgttattcatatcccaaatatatgacatattgaaattattttttctttctatagtatattgtttattaacaaaagctgtccttgcatgacaaaggctgttttattttgtcattgcatatatctgccagtttgctggaaaaaattagactacaatattttctgtcaactattcaacaatattattcctttgacttctcacatctagagttgctgttgtgaaaaccaataagtatctaataattgttccttttaattgatataatttcctttttaagagaattcagaactttctgtatagtgtaactagaagttaattttaaaaattctatagtgcttagcagtctgaaaactttataaatctgatttataatataatcatattgactaggtattaaagttttatttttgttaactatattttcttttttctctcttattaattccatctatgtttctgtagatttgtattcatgtaagctttctttaattttaagtgcacatttatttctttcattatttcaactaccatattttatcatctagtatcaccaatgtattttatatttgcatttatatttgttcatactccgtttttgagttttatttatttgattatatttgtatgcttattttatattacattcatatttttcattaattctaatttgctactcttgttcagtatgctgtcctttatagttctttatgtcccttatatatccattttttttcctgtaagttcattttttttttttttttggaaccattatctacctcagatcataataacaaactgaggggagggagaaaaagactagtttctggtttataccttataaagcttttaggatgttagagagtgaggtaggggatgcctcaaagtacaaatctactgcttttatgatctggtctcatttgtccacacacctccttatattaaaatataacatgtccttttgaaaatgtttctatacctccacttaaggcctgcttaattctaagatttatgtttcaaagttaaaattactaaatccatacaatgaccatatgatcacagagggtcagaagcaattcaattcttgggagtgaaagcatcatatatacctgttgctcatccttcattccgtctgccctctagtgcaacattgtttttgttctcacttctcgatacaaagatcagctaatgttatttcagctccttagaatcagagtataatgtgcctactatgaaggagagaaatgtatttatatagaatagcttttcacattatattgttatagttaaactgcccccccaccacctttctccagtgcattttttttttctttctttctttcttttgtccacagcaggatctattccttttgcatttccaggaaattattaagattttaatattaatttctggcataaaaatattttttaatttgtgtaggtggcaggagaacagtagcctatatttattaatactcttgtcaagaaatagcagcttctcatgtacttctttttacatattttgttactcctgaatttttaatcttttggtttatgtttgtactgactagaatagaaggataatatttcatatgtgcagtatatatattatgtatatttatataagtatatatacacaattccctctaagatatgtacatatatatgtgtatagacataatacacacatacaatcatataatcttataaatattcacaatatgagactctgtgaaagaagttctttaaaatgctgatcttcaaataaaagattaatatataatctataagttgtgatctttattttggctatatatttgggacttcttatttataaattagcataattttattgatattatacaatttaagtgagtaaatgccagagtccaatcattgagctcgggatctatgcctaagtgtgattcttggccaagaagaacaattgatggttgactcagtcttatgcataaccctgagggaataaatctctttattggccttcctatataaatctttccatttatataacctttccataaaaataagctttatctttggtatattaaacacttatcttgttcattaattttttcattgaatcattgtttggaatgcttaaagcataacatttagtccagtaaatttgcttttacgccaaacctcaaacgtaatcagtgaaaatatattttatttcttatccaagtgtattatattactttggtatggctactataacagaatattatagattgggtaactgaaacaatagatattaagtttctgtcagttttggaggctggaagttcaagatcaaggtgctgacagggttggattcttctaaagcctctctctttggccaccttctctgtggatgcatgtggtctctcttctgcatgcacacgtgtccctagtgtctcatgtgtgtcctgatttcctcttataaagattcaagcttagttagattaaggtgcactgcgatggccttattttaacttaattacctgtttaaaggcatctatctccaaatacaagcacattctcaggtattgagggttaggacgtcaacaaatgaatttgagggggatacaatttagcccatagcaccaagaattctgctcagtaaatatttttcataacattagtgcagaaaaaaatataacattgtgtaataaaaaataaatactttcaaaaattatttaattctgtagaatagaatcccagagcaattcaatgaaaatgaaggaggctatcttttatttcttggtacaatagttaggaaatgttagtagaaagggtatttgatttgagaaaagatgataaaccttttatatatatatatatatatatattttttttttttttgagacatacagtggagtacagtggtgtgatgatagctcattgcagcctggatctcccaggcataagcaattctgtcatctcaacctcttgagtagctggactacaggcatacacctccactcctggctaatttttgtattttttatagagacagggtttcgccatgttgcccaagctggttccaaacaactgggctcaagtgattctcctgccttggcctcccaaagtgctgagattataggtgtgagtcattgcgcctggtccagcatactgtcatactgagataatgatccttattaagccccttgacccctacaagccctgtcattttttttcatggcatgtttatggaataatgttttgggagatcaaatgaattatatatttgcaagttctaatataataaaatcgcaaataatcatatcttattgtttgatattactatcataattatcatcatgttcgtgtaacatacatttgacaaaaaataaatgcatattttctgggtaattttaaatggaaataattaatattaattttgttgaagaactttatgagacccttttcagtaatttagaaatactcctaattctgtgaaaattaatgtatatttttaagaacctattatgtataaaaagctagattgggtgttgtgcatgatacaattgtaaacaaaacgtattccagtttttaagacaattgtttccagtaacagtaatataccaaattgaatatggatggttccttaaagataactctacatgaagtgtggttgtagcccatgagagtttgtagaaagtcatgattgtaactgttttgtgcagagtgagaagataagaaaatacattttgagaaggtaattgaaaaggagagaaatgggaggaaatgagacctatgtaagaaaattcatagtgtgagtttgagtgagaagtaattaggtcctgaaataaagtaaaatttgaaaactggataaaggaaagataaatgacataaatatttaaatgcagggtttgcaagctgttagaatattcttttcctgccaccttcactttgtgacagtactcattctaccttgcatcatcagcaataatagttgtattcttcttttgatcctgtatttatggaggtggcaatactacattttgttttcctcccaccaaatagcatgagaacaattacataaaccatttgtattaagcttgaagaattgaattgcattgaaacaatgcaattgttgaaacagatggaatcaaaaattttcatattagatgatagtggtggaggaaagtaaaaaagggtaatgccatttatataaatacaaattgcaaaaaagaaagttttcttaggaaagaggtttaattcactctgggctgggtctagtttaagaggctgggattaagtagatggcaatgttaaataaattattggacattttattgtcccttaggggaatacctctatccttcctaaatgtaggaaaaaatctccctacatttgaagtataagtaagggaaaggggttccattaacacattattattctagtttttaaactgatggtcttaccaaggtgaagttgataagaaaaggcaatggtagaatattaagaaaatcaaaagttagaaggcagggaaaaggaaaaacaacaacaacaacaacaaaattttaaagtagattagaaaggtggaaccagaaaagtaaagtgttttatgccaaggagatgggcagatgtcatgaagtctagctaaagaatgtgaggaaaccattggtctgtgactttaaagcttcagtgtacaaatagaaaggaacaacttgaaaggtcaagatagaaaaagacaagaaagagaaagcatgctttttagaaagaggacttggaagacacaaaacagcacatgaccaggcaacagaacagagagggtaaaaacagaatggagtagttttgagaatttacaagataggcataagctgtttgatggaaccaattttaatggcttcagcaaagttgaaagcaatgtcgcctgatgacagagaactagtaacaaagtatttcaatgataaagaaaagtaaaaaatattttatatggacacaccaagaggtaagcacaaattacaattaacaaagaagactcgtgtgacccatcattaataataaactctgggaatttaaagaattgaattctagaaggaattttgcctctaaaacatgagatgctaacactaagtgaacaatttaaggcttcacttttgtcttttccaactgtaaaatattttctaacagtatttatctgatcgaaataattttatgattcctaatgaatccatagcaaactcctagtgaatcatagtgactctcactgaaagtgagtgcttcaggactttgaaaaataatagttactatacagccatttataaccagaaccatgctattataatataaatctcaaggaaaaaacttcaaaatgttgtgttatacatattttgtaaataaataatatgtaatatacatgtatacacacatgtccatagttaaattatgtttaaagaacaaactttttagtgtcgttaagtaacagaagaacagatttagatcaaattacttaaaattaacatcaaaaagtattattggtataagttaattgaaataaatttgtacaaccagttattttgagaatgtatatctaagtatttattagattgttttttattatggttactagatggtttatgtagatatgtactttatgttttctgaacacataaattgaaaaataattgtcaggtacaactaatgaatccttttgattttgcattttgtggttctgtatcacagacttacttttgtttgctccattttgaatggtgccttactttattattattacaatgattatttcttgttgggcttttatataaatttcaagtttattcagtttctacttctagttgtttaaatttaagagattatttgcatttcctgaaactatagctctttaattctgtaacattacttgtcctggattattaaaatgcaggttcatatgacttccgttaaggttcttcatgcatctccacttctctctctgtgaaataccttcaacagaaactgttaaaaaggaagaacttctctttccccaagtggctgcagtaaagggaagtaatagactgacaaggcttttagatgtaagaaaatgtcttctggattaattactccctaaaactttatatacaaaaagtctttgatactctaagtttccttatcaaactaatgagtttactcttgcctatacctgtttccccatccttgattttacttttccaaactcttacggtgtaaactgcctaattttgctatgtatgagatacatggacacactcaacaactatactatattaggtagaaaatcatattattgtgtgtgagatgcatggtaaattgagtgtatgcagtcttctgggaaaaaccattaataagtattaccttgttaaaagattttagaaaccatgaaatacaaaagcagggcatgtgaatgtatttatgcttttaatgcttgagtgcaatatgtaactacagctttatgaaaacttaagcaacatgtatatatatacatatataaataataaactttattttagagcattttaaagttcacagcaatattgaacagaaagtagagaaagttacagtatactcaccagtcaacacacatgcgcaatctctcccactatcaatatgctgcaccagaatggttatatttgttactattgatggacttaacactggcacatgattatcacccaatgtccatagtttatattgtttcactcttgatattgtattttttgggttttgaaaaatgtctaatgatatttatctaccattatagtgtaatgcaaaataatttcactgccctaatcctgtgttctccctattcatcccgccctcctttcctcctcctcctcctccccccacttcttctttttcttttttcttttcttttgagacagagtctcactctgtcgcccaggctgaagtgcaatggtgcaatctaggctcactgcaacctccgcctcctgaattcaagcgattcttctgcctcagcctccccagtagctgggactacagtcatgtgccaccatgcccagctaatttttttgtattttttagtagaggctgggtttcaccatgttagccaggatggtcccgatctcctgacctcatgattctcccctctgcctccccaagtgctgggattacaggcgtgagacactgcaccgggccccctcccttcttcttaacccataacaatcacttttttttttttaatgactccatagttttgccttttccagaatatcatacagttagaattatacagtaagtagtctttcaagactggcttcttgcactgagtaatattaattttattttctttcatgtgttttctttcttgggtagagagttcatttctttttaataaatagtacttattccattgagttggtgtacctcagtttatttatccacccatctcatgaaaaacatcttggtggcttttaaatcttggcaattatgaataaagctgctgtaaacattcatgaataggattttgagtgaacctaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatgttagccattttaataggtatgtggtggaatcttaatgttgttttagtgtgcaattccttaatgatatatgatgctaaaaaattttcataagcttactttctatccatagctcttccttggtaaggtgtctgttttgatctctccatttttaaaatgcgttgttcataaattttaagagttctctgaatattttggttaatagttctttattggaaggttttttgcaaatatttttttcccagtctgtcatgtcttctcattctcttgacattgtcttttgcagagcaaggttttaaattttaacgaagtccagcctatgagttatttcttttttttttctttcttttccttttttttttttttttttttttttgaggcagagtctcactctgtcacccaggttggagtgcagtggcgcgatctcggctcactgtatgctccgcctcctgggttcacgccattctcctgcctcagcctctccgagtagctgggactgcaggcacctgccaccacgcccggctaattttttttgtatttttactagagacggggtttcaccatgttagccaggatggtctcaatctcctgacctcgtgatccacccgccttggcctcccaaagggctgggattaacaggcgtgagccaccacgccaggcccaagttatttcttttatggataatgcttttggtgttatatctaaaaagtcatccccatacccaaagttacctagattttctccattgctatcttctataatttgtataggttagtattttatatttcactctatgatccattttgtattattttttgtgaaacgtgtaaggtctgtgtctagattcatttttctttttttaaagtttttctagcactatttgctcctttgtattgccttttttcctccgtcaaagattaggtgactatatttatgttggcatacttctggtctatttattttgttctattgatcaacttatctattttttcaccaataccacactatgttgatcactgtaactttacagtaagtgttgacactgggtagtgtcagccctcttactttgttcttccctttttttatttgaattgagtattatgggccttttgcctctccatataaactttaggatcagtttgccacaatgcatataataatttgctaagattttggttagaattgtgttgactttatagataaagttgaaaaaaactgacaccttcacaatattgagtcttcctatccatgaacatgaatgtctccccatttatttgattcttttttttgaaatcattcatcagagtattatactttttctcaaatagaccttgtgcatattttgtgagatttatacctaagtatttcattttggagggtcctaatgcaaatagtaatgtgtttgtttttaatttcaaattacatttgctgctatataggaaagtaactatcatttgtatattaactttgaatcctaaaaccttgttctaattgtttattggttccaagagggggttgtaggtatgtggccttatttctggattctctgttctgttccattggtctatgtgtctgtttgtgtaccagtaccaccctgttttggttactgtagccttgtagtatagtttgaagtcagtaatgtaatacctctagctttgctctttttgcttaggagtgccttgactattcaagctctttttggttccatgtgaattttaaattttgtttttttctagttctgtgaagaatgttattagtagcttgatcagaagagcatgaatctgtaaattgctctgggcattatagccactttaatgatattgatttttcctatctatgagtatagaatgtttctttatttgtttgtgtcatctttgatttctttgaggagtgttttgaaattctcacggtaaagatcttttacctccctgatttgctgtatttctaaatattttattccttttgtggcagttgtgaatgggattgcattcctaatctggttcttaccttggctgttgcttgtgtataggaatgctagttattttcatatgttgtttttgtaactgaaaccttgctgaggttgtttaccaacttattgagcttttgggctgagaatgcagagctttctagatatagaatcatgtcatctacaaacagggatacttttaatccctctctttctacttgggtgtcgtttatttttttctcatgccacattgctcttgtcacgactttcaatactattttgaataggagtggtgagagagggcgtccttgccttgagccagttttcaaggggaatgcttccagctttttcctatttagtatgatgttggctgtgggtttgttagatagctcttattattttaaggtatgttgcttcaatatctaatttgttgagagtttttaacatgaaaagatgttgaatattattgaagccttttctgcatctattaagataatcatgtggttttgtctttagttatttttatatgatgaatcacattagttgatttgtgtatgctgaaccaaccttgaatcccagggaaaatgcctacttgattgtggtggatttgtttttgatgtgctgctagattcaatttactagtattttgttgaggattttgcatcagtgttcatcaaggatattgtcctaaagttttcttttttttgttgtacctctgccaggttttggtatcagaatgatgtcagcctcatagaataaggtagggaggagcgcttcctcctcaattttttgaaatagtttcagtaggaatggcaccagctcttctttgtacatctagtagaatttggttatgattctctctggtcctgggcttgttttttggttgacaggctacttattactgattaaattttggagttcattattgttcttttcagggaattaatttattcctggtttagtttttggaggttgtatgtgtccagtaatttattcattaatttaccaatttcttctagattttcacatgtgtgtgcaaggaggtgttcataatagtctttgatggttatttgtattcctgtggggtcagtggtaataatcccttcattatttctcattgtggctatttggatcatctctccttcttctttattagtctagctagtggtctatgtattaatttttttttcaaaaaacccactcctgccttcactgatcttttgaataggttttcatatctcagtttctttcagtgcaggtctgatttcggttatttcttgtcttttcctagcttttgtgcttggtttgttcttgcttctctagttcttttaattgtgatgttaggttgttaaattgagttctttctaacattttgatgtgggcatttagtgctataaatgtgtcccagaaattctgtgtcccagaaattctggcatgttatatctttgttctcattcatttcaaagaacttcttgatttctgccttagtttcattatttactgcaaagtcattcaggagcatgttgtttcatttccatctaattgtatggttttgagcaattttcttagtcttgaattctattttattgtgctgtggtccctgagagtggttggtatgacagggggttcttttgcatttgctgaggattgttttatatctgattatgtagttgattttagagtatatgacaagtgtagaagagaagaatgtatattctgttgttttggggtggagagttctttagatgtctatcagatccatttggtcaactgctgaatatctttcaagtcctgaatatctttgttaattttctgactcaatgatctgtctaatgctatcagtgaggtgttgaagtttcccactattattttgtgggaatctaagtctctttgaatgtctccaaaaacttgatttaggaatctgggtgctcctatgttgggtgcatgtatatttattatagttagttcttcttgtttaattgaaccctttactattatttaatgcccttcttttttttttatctttgttgatttaacgtctgttttgtttgaaattagaattataacccctgcatttttctttgtttctcttgcttggtagatttttctccatccctttattttgagccagttactgtgattgcatgtgaaatgggtttcctgaagacagcataccattggatcttgcttctttacccacttgccactctgtgccttttaactaaaggcatttagcccatttacattcaaggttagtattgatatgtgtggacacacacagtcctacaccagagccctgccctactgctaacactgctacgagtacagatgtgcaaacagttgctatcaggtcctttgccccccagatcatactgccactgttgctgcggccaacacctgtacagaggccagcaccctggcacccactagcaccccacagcagctaaatgcatgtactccaccgtgctgctgctgctactgcttctggcacatgcaaatgagtatggatcccactgccactgccctgcaaagtgctttggctggcaccacccttcagagtgttgtgaccagtggtccaggagcacttcaccgcctccagcacagcaggtccctaaccttgaggaaccagaaatcaaagctataacctaatatcaatggctccccaatcagatttagaaaatccagtccaggagtcctgatctgagccttggcacccttaaatcttccagtaatgaagccagttgactgaacccaccttatatcacaatcaaacccccaaggtcatcaaataggataaaagaaaaaaaatccaaagggcagcaactttaactactgaaggaacatcagcccacaaagatgagaaaaaaacagcacaagaactctgacaactcaaaaaactagagtgtgtttcctccaaatgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccgaaagaagcactaaatatggaaaggaaagacaattgctagtcactacaaaacacacttgtatatttagaccacacaaacaagttggcataataaacaactgaaaacatgatgacaataaaaccaccacacaagcaaggtggcaggagatggagagagtgaagggggaactgccaaacacttttaaaaccatcaggttttgtgagaactcactcactgtcatgagaacagcatggtggaaactgtccttatgatcccatcacctccccaccaggttcctcccttgacatcttgtgattacaattccagatgagacttgagtggggacataaagccaaaccatatcaattgcatatgatattcctaggtatagtttttttgtttggtttggtttgttatctgtcctgctttgtgttctctgtactttctggatatgtagtttgatatctgacattaacttgaggacaatgcccaggcattattgcctcatacactttttctgcccctttctgtctttcttctccttttgctattcttattctgtgtatattatatattttatagttttcccacagttcttagatattttgttctgatattattttcagtatatttctctctttatttttcagtttgagaattttccattgttgtattctcaagttcagagattctttcctcaggtgtgtcccgtctactactaaaaccatgaaagtctcattattcatttctttacaatgcctttgatctctagcatttctttattagaatttctatccctctgcttacattgtcaatctctttttgcttgttatttactttttccattaaaggccatagaaaaataatcatagtttttaggcgttcttggccggataattccaaacttactgccatatctgactcttgttctgacaattgttcagtctcttcaaacttgtgtttttgcattctagtatgccttgtaactttctgttggaaggcagacatgaggtactaaatgtaactgtagtaaataggctattaataatgtagtgggaagatataaggggagggtaacttttttccagtcctattattagatctcaggcttttggtgagcttctgcttctggtctacaatctcgcagatccctcctctgtttcaggtgaggcagaatgactggaaggaactggaattgtgtatttcccttctactccatggaagaatagacagagcttgagttgagtattttccttctcgccaaatatgttaggctctgatataacaccagcaatttaggctctggtaaaagaatttctcctgaggactggccttgttaaaaaggacagtaaatatatggtgaagtatttcaaaataggtcctgcaccatgactgggttcccctagagtttatcttttagtttccccccacttctggcacccagcaattcatcaattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaattaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgatgcatcagctgaaatttaaggctagagtcagtcaaactgccatctcaaaactagtctttaacatctggtttgataccttcttaacatggtatcttttagatggatggtgttacaggaaaatcctcatagcaaaggcagcattcctggacatctgcagcctttttagaatcaacagaaatgctctggtgaagtagctgtgacatttacctcagcaaatactgaaattatgctaactgtaaaatgcacttcctcttcctactgcaactgctcttttgggaaaatttactatcacaatggccccagactaacattcttactcagatgctcacattttatcctgagtgttcaaacacctctctgcctttccagaaaggaatgaaaggagtgcagttgtttttcacaggtgggcatttactcttcagctttcctaactgtatgaggtacaagctttctttgtgtcaatctatacatgagatttgtgtcagtcttttcagtttatcacttttcaaccagtttaggattatgagctttacttttacacacataccaaccaaggcaaaggaatattgggaatcacagcaagagcattgctctcttctaacaaatcatccttgacatatctactcttaatcttttaaaatcatctttatatatccctttttaaattaaccatctaactgcttctagatctcctactatgaaatgtctaatggttgtctatttcatatttacttagtgtattatgctcatgatttctttgcgcatcaattgaaatgtcaaatttatcatcatattacccatacagttgctaaaaacatttcagacagatgcagcatttttaaaaatattgttttctgctatataaataaagatgtttagttaaaaaagtcctctttaggttaaaaagactatattgtgtagaaataatgtagagtccttacaggaagtaaatgacattccacagagtaagtatctcagggtcctgtctttgatatgattgctaagaaaactcttagacctttcattctgaaattgtttttagaatacccttgcttatgacataagaattagttgctttatttatagtgttaaagaaaaaaaaatcagtgatacatgttaaaacattgtatggaagactttcttcaggacctttgctatagctttagggttcactgcaatgggatattgtagtagggaagagatattgggatcaactcagaatacatcatgggcaagtagaaatttatagccatggagcagagtgaggctcagtaggtgaaaaattagtaaaaggaaacatcagggtaaggagattctagctaaaccatcctaagaagattctgctgaagacaggccaaggtgatcagacatcccttgccggatgatgaagaatgaggaacccagtgagctattttgggtcattggacattaagaatgggagcttcttgctaaactgacttaacagggttctttgctaaaactggattttataaagaagttcatagatgtgcctaggtgaaggttcgaaagccttgggaaagtttgatcagagaatatttgtcaatagctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtacatatttgagaatattcatataaaaagaagttgttttaaattttcattctatagaaaactatgtgcttcctagacatggtcacaacactcatatgggaagtaaagatggtaagaaacattctaatgaaaatgataatgctttttatgaaaaatttcacattttatgttagctttctcaggaaggatagaaaatctgaatgataaagacaaatagttaaagtaaaagttcaaatactattgtattacagtctaagatgttgttattactggcattgattccctagttattaagtgtcagagtaaataaatctttgtttttataaaatccttataaggaaatgaaataaatgtgagtactgaatttttatttcatagaaaactgagggtaaactagttcctttatttttagtttatctgataatagacagttaaaataatattctttacaagataattatgtaaatatattacaaataaatcatctacattatgttgactgaactttagttttatttcagataatttttatatttaatactgttttcactaatgctattcaatagctttcaggtagtagtttgctaattaatatttgaagtaaaatattaaaacccattaataataatagaggtaatgtcctagagttttactgtttgttcttttagaggcttattagtattttttcagactcgtatattatattcagttttcagtttgcaccatattttcaggtgatgtttcttttatttaactaaattcatccatatctaattctcatacatttttagtcacagctgagctaccctgcttatgtattaagaaggttgaattataattatgatttctttaaagtgtccttgaaacttcacccagtctagaatgaattttgaattttaaaatgttagttttgtgagcgggtgtcacttttgttttaaatagtagcgtagacctttcttcacttgtttcaaacacaacgtggccaggatgctgatacattcggaaaaaaaaaaaactatggatataaatatgcaaaaattttatttttagaagggtagatttagatattaatataaataatttatattatttttaaacttcactggctctatgaagcatagttctcttggttcctaaaattcattctttttctttccttttaaatgagtctgtctatataacacacacatacacacacacacacacacacacaacatatatttatatataaaaatttaacaagtaacttatatacatataactgtgtagtatttcaaaacagagtccataaatcatgaaaaaaaaactccatacacagttgttaatgaattaaaaccatgagtcatttctcagtgaagtagttatttcttattctaaaatttgataaaattggctaaatacagacatacactcacaggtacacacatacattttctgtgactatactttgagagcctggtttcctagttacttttgcatactattgtaccttacattttggtaatccaaatgtgagtaagccatgattgtgccactgcattccagcccgtgtggcagagtgacggcatgtctctaaaaacaaacaaacaaacttatcttaatgcaaaagaaattggatacattttcatgattaatttgaatgtttccttcagctattctataataactttatgcaaagttcatactgtcagaattaagaaagatgtattattgattttttttctgaagatacatcttcaatattatattttttataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaagtaagagttgatatgatcaagattgagatttaggaaaatcatcctgtctcagtgtagtgaacagattgaaaaggacagtggtggatgtgagaagttgttagagtgttgcaagaatgcaggagtggttaagagaatggcatactggagagtggccaagtaacctgtgtccaaaaaaattaatttaaatttaaaatatatggtgatcattggcatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggcttgaacatgtttaaatgttgtcagtaaaaagggaggggtaaaaaaagaaagaaataattatataagattcctgtaagtaatgtaagaatgtgatggaatttaaagcagaaaatgaaggattcgctgtggcttgtagggtaacaaacagaaggagaagaggagagattttgacagatggtctttgacataagaaggttttggattgatttttgagtgtgtttccataaatggttttatttttctctgtaaagtaaaacccaggtcaactactaaaagtgagttgagtccacagaaagttttgagtgtcaggaaaggagcaatttgaaattgacgttgtagagaataagttgaaagagatactaagctttctgggcagggttgaacatgtgcttcagtttcactcttgttagtaccactttttccagcaatgctgtgctgcttcagattcagaagacattgatagttgagttactccagggctggggttgggttaaacagttcaaaggaaagagagagtttagtgagtttaagatattggcaaaagtaatattgagatttatatcatggaaaaatcatctgaacatggtataatataaaaaaggagaaaaatctaatgaattgtaagactgtaggtctttaatgcgcatgaggctccagtgggattggaaaatattaccggtaaagaaactgaataaacaaagtggggagaaaaaagagtctaaaatcatagagcaggaaagttgagtaattcattttgaaagtaaagtaaattcaggtgttgaaaatagtgttatgtgaccatgattggctgaagcactaaaaaaagtgttggtaatgattttgaatgactgacaagtcactctgagtcctgtgtgaagggcactctgtgtgaaggactctgagtgacttgtcagtttcaagctggtgaaagagaaacagaggtaggctggaaatgacttgtactgactttcaggaaataaatttacagaaattttatgatttggctgacataatacctgtagcttgaaatcattaatagtggatataaaatcagcaagtaccacaagtaaaaataaagcaaataaaaattggcaaacactacaaatcagggcaagtctcccttttccagagagacaactgttaaacatttactagttcatcactgaggagaagcaaacatctgtatccaggaaatgaatagaagactgtagtaaaataaatcaggtagtaatattgaatggttcgaaccttaaaagaacagggttttgtaccttcgcttcctttcaagaggagtgtggaatgtgtgatttagaagtaggaaagaaacaaggatacatttcccattcttgatgtatgtggagtgtgaaatacatttttcattaatgtattaaagctgtactcaaaattaaatagaatttaaaattatttatgtagagcaataatgtggctatccttctattttgctttaaagctgggtcaggtatatatacatatatttttcttattgaatgaagccatgaacagaatatgagaaaaataagtacaagtctagttattcttaattaaactgatttgatcattacaaattatatgactgtattaaattatcacatgtgccatgatatatatatatattatttataaataaaaataaaaaacaaaaataaataaatattaatggatatatagaccatctccactgaaaaatatcttggaatttatatagtctaatccgtttattccacaattgaacaaattgacttctagagagataaacttactcactacagatcatttagctttgtaatgttagagctgaaagtaatatgcctgtcttctaaactccagcatgataggaataatttcattgtatgcatctagtcattcatttatccatttttttctaatttattcaataagtatctattgatatctatgatatactagacactgttccagatacaagagctataaggataggggaaaatccttgcattaatggaggttttcttctagtaggaagagagagaaattgaacagataaataagtataaagaggaaatacataatatactacctagtcattaagaggtatgaatacaaataaaatagacggaggataaggtatatatatggtgagtcgagggttttaattttaaatagggtaaatattagaaattctctggaaaaaggaatgtatcagcaaacatcaagaggaagtggagaagcgaggcacatggatatgcagggaaaatgcattccagctagagaaaacagcatagtcaaagaccctctattaaattgtacccctaattaaaatgtgctgtaaattaatgattaatataatcatcaactactttatacatactcatattgtgatatgttttaattctcagtgtacttgtaatgcattataagactttaagctttgccaggacaggggtcatgttttgtttttggtaaatctacgcacacacagtgcgtggcatggttatttataccaagctggtggtcaatatatattagaatgatagatcaaatgattgaatgaataatctagtgaattattaaatagaataagttgagttttaaactaaaacttttgtgcctctaagtctcctcacctgaaaaggcctggcgttaagggccatgttggttaaagctcctacctcagcaaaagctcagggtgctttttctattcttgcttactagggtgattaaataacaatagaggggaaaacaagtttccttatccttaaaaaattaagaattattttaatggtaaaggcatatacatatacacttacatatatatatatatatatatatatatatatatatatatatatatgaagacagtaggtatatgctacagtcatctcatgtacaagtactgtgtttctcttttgattgattatgtaaaacaagcaacgagaataaattctgattatctttacagagctttatggactgtcaaaatggctttagatgagttttctcatttatttatcacaatacttccacgatattgttaaagaagctttttattacattaggtagggaaaagaaattatggcttatccaaggtccttcattgacccagtgtggtaaagtttcttaattgtatttcagtttgtccacatgacagtaaaatatattcttgatggctattatttataagaaaagaaaatatttgatcaggaaagttgaagacatctcatttaaaagataatatgcaatgaaccttcattatgagatacttggaatggtacacaatgaactatcaaatgctgtttcaactacctaaaaaggataactgtctttaactgcaccaaatgatactaaacttgctgcctatcctattatgcttagtcactctgatttcttttattcctctattaactcacactaacactgagaagagcaattctctctgtttcattgtccttcccttcaaatatcctgttttaagagattacagatgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccagatagggctcagctgttcttacctagcacatatgttccagtattgttggtaatttatttctgtaataaaaaattaaaatggaaatctcagccagaatctcttttaccaagggagaccttgctatgagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaagagaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgataatgttattttcttatcacttttagacagtcaggttcataaaagcaagttcaatgagcataagatggtttctaaattttaatttatttttgacagcaaacaaaatgaacaaaggtgaggaatccatttgtgtacctaagatatctttaaaaagaagatacctttatatttgtcaaatatgttgctcccagtaaaagaaaagaagatctatgcaagtggttcaagagtaaaccttaccttattagcttttcataatattttcgaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaaactaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagaaaaaaacaaatcggcttacaagcctcggcatttttataaaataaacattgctaaacattgacatcccaaatccatctaatataacatagaaaaataagtttctttaaggaaaggaggaataaaatagaaatacattctagtatttttagtggcagataggataagtttagtgggaaaataagatgatttacgaaaacttaaaaatgcatttttcttacagtgctttttttaagatatgcatttcatgcaatatctctgagacattatttaattgattctcttggctttatctggctaattactctgtataatataactataaggataataattaagaaatcgttttttttatttttgtcaggtaagttataatctttttatgttttatgtaattaaaattcttttgcaaaatcatgatgccatgaattttatctattttcacttttttttaaggcaaggagctttggttctctcaactgtgtaggaaagaaaaatattttaactatttcttatcttttacttggctaccctcaaggtgagctctttatgatcctctaatttgttgttacctcaattatttgctaatagaaaattattttatgatgtgcttagcttactacctgtcttttattttatatatttctcttaggtactacattcttttggagagtatttcctaataaatttggcagcagctatggacagggcaaggatgtgtctcaattcctgagtctttcctggtgttctgtctcagtcttcactttctctcatcacagtggccagaggaccttcaaagactgtggacattttggctgatcagcttagtccttatgtttgattttaatcaggtcccttggcaatgatcagtatctacttcactgaaagacactagccattgttacaggtgatggagcaaaatgtatttacaggtggctccttcaacatgccggttgttttccacgtataatctttagtttatactgcaactttatatttcctttcttctatgtcaatttgcatacaactttcatattcaacatagaaatatttgattaatttcatttttacctcatcactgatcctaagtgcatttttattccttttctttaacttgtacagctcccatttattgatttttacgtttcaagttcctataatctatttaactttgagaatgttcaacaactttttgctttattaaaaataaatctagctaagtcttcttattttccccttacacaatatattttacagtggaagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagagtctttcctaataaatttgacagcagctatgcacagagccaggctgagtctcaattcctgcgtctttcctggtatcttatctgtatctacatacatatatataaagttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgtaaaacaagttgaactcatagaagcagggagtagaatagtagttaccaggggtttgaggggatgaaatggggagatgttagccaaaggaactttgcattattgattgttctttctttttctgacattttaaacctctcctttcttttgaaacatccgccattggcatttaaacatgctcaaatctcttcaatcttttaaaatcttacttaaaccaaaatattcttctatctgctattctggatctgctcatcttcagggttgtactttttattttattttttttttctttttggcacttactgctaccagtttactttcctcaaatcctttcttaatccactttgatgtgacttctaagagcttcactcccctcaattagcccttgctaaaataaccaagaaactctctgttgccatatccaaaggaaattattcagttttcattgtttgtagttttctagcaaaatcactacaagggaccacttcctcactcaactttctcttgccttaatttatgcagtacttagattttcttccttctctgtttactctttttacgtttcagcctcctatgccagctggtgaaattcaaaattccacaagccttaatcctaggactcatcttatcttcctctcctgtctttttccacatctatccacgacttggtcaattgtatctaatatggcattcaaaatctacatttttagctttgatatcccctctgaactccagacttaatgtctaacttcatattacagatccatttgaatgttcctcatgggtccccaactcactaggtataatctttctcccctaaaatttgatcttctttcagttttttcctctgtcagtaatgctcaagtgtaaaccagaaaccaaggacttgttcaacctaaacctcttctttttatatttcaataattaccaagtattatgcattacacacacacacacacacacacacacacacacacacacacacacacacacaccccctttgagtttctggatgtctttccatctccaacaccatttccagagtccaagtactgtttccttagactgatgctatgtgcttctaaatggtctttttacatccattgtagtcttagtgatctcttcaaaatgcaaatctgatttcatcatccatagacaatctgcttcataattgccttcacttctcactgctcctatgattaaggcatattttgttcttgcatgttaactatttatgaaacctggaccctggtcagtgtctaaaattgtgcctattacatgaaagtaattcaatacacatattttacttatttatttttattttaaaaatttttaataatttcaacttattttagattcaggagatacatgtgcagttttgttacatgggtacattatgtgatgctgaggtttgaggtacagttgatcatgtcacctaggtagtgagcatagtctgcaatatgttttcaaccgttgcccccatcatcttcctcccttggtaatcccccgtgtctattgttgctatctttatgtccgtgaatactcaatgtttagctctcatttatatctgagaacgtgcaatatttggttttctgttcctgtgttaattcacttaggataatggcctccatccagctgcatccatgttgctgtaaaggacatgattttgttcttttttatgactgtgtagtattctatggtgatacacgtattttaaataaaagagtaacttggctctgtgaaagcagaagttgcactgggaaaagttaaaccaacaaggaagacttttctattccaaaaaggaagagagagatcagaagtcaatctctgaactgggctgaaactctggagagttttaaaggatggtttgggagtttttaagggtgaaagagcttttaacaacaattgggtgggtatgggggattatgaccatatgtgtttgctaattgggattatccaagggaaatataaactttctcatatcttcgtcacagaaagtagttttacaacttggaagaagggaccctctgtctgaagttaggtttctacctttccacagagactggaagatagagatgcctccttccttgatgattacctttcaaagggttgggtccaggccctttagaaagacagtctggtgttgaaaaactgccaagagcctttcaaaaagatttacatttaaaagggacaaataaagaatttacaattacaagaattcggcagtaaattatctacgagaggggagggaaaataccttgatgcttaggctatctgaatcatataagggactgagtgagcttaagatggggcctggaggtcagaaggagcctgcctaaagtttaaaaagctgagggaaggcttcaggtcaccttcattactccttatttattttgctatcattttctagcactctgttccttagctcatggtgccccagccaaagaatactttcttcaattatccctcccatcgagttcatatccaaggtagcatctcttgagtgctttctctcatattagagagttcttgatgttgtaaatgcaagagaatgcattttgagtttttgttttgttgcatttgtaaaatatttcttaccactttgaggatcatttatgccattctgtttgctttagtctttatattttcagttggaggctctcctcaagtatctggttatccttggctgtttgatcatatttaatagattttaaaaggctcactgcaaactctaggtgcttactcaaagctgaaaaactgagtttcactgtggggtatatagtgggtaatttagttagaaaatccatgaaatgtatatttagatagagttggtgtagtgcactgattaagattatgaaacttgtaggaaatcttcccatgtttgagtcctggttttgccactaagtagccatataattttaggcaaatcattaacatcattgtgttttggttttcttgtttataaaaggggtacaaaaatacctacatatttttataaaaattaaaaattttagtatttgtaaataatttggaatagcatctagcacatgctaaaatttatatatgtgtaaacttttattattactattaatatttattttgcttgaaaaaaattctattattctttctggaggaagtatatgaatcaagacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccatgtttattttggctttgaaagggatctagaactgactatctctggacatttgtggagtgagggtgtattctaaagttacctatttcctggtaggtgaccagcagataatcatatttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttgttacaccaattaactgttagtattgtagatcagatatttcaaatgtgaaataatatgatagttcttagtaatttaacatgaaactatatacatttgtaaaggatacagtagcaacatgtcttaaagttggttggttttcagttgtgattaaaaaaaaatgtttgatgtgtttatcacatggattacagtaaaatattcacaatgaatggatttgtgtactattataaaatataattatcttggccaggcatggtggctcatgcttgtaatcctagcactttgggaagatgaggcaggcatgttcagtgtttcactggggagcaaaggtttgcatttctacccggtcttagccctgattctgtccttgtctttatagagcactcattgtacctttttctttttcctagtaaatcataaggtacttatttccattttatcattgaaacagtgccaggatttttctctgtaatattgtgggcctgccttgtagtggaagtagtagtaatatcacatttatttccttgcacatgtagaaataaaagcacacttaaactgtaaaaaatattccatatctatttgcttgaaaagagttttaactttttatgataatacaagcagtatgatgaatatccttcctgtgtttgtaacttcaggattatttttggtatttgtataatataataattaaatgatgataagggtttcacagatgaactttcaaggagcagatgctaacgtttttcctgtttatgttttaccagggccttctgaacaaaacctattttcttcttttagtaataaaattctagtaaagccctcctgagaattttcagttggatataaacactattcaattgtattggtccaggaatctttagttatttagtaggcctgaataatagatttctgaagtccagcttaaagaagtactgaggtgatcaaattgtttctcagtggaaatgtagacatctttatttgtaacatccttatttgtaacacattctgctcgtctcttcaacccatacattttttgtgtatccctgggggttaatgtagcatctgtgttacgttaacccaagttgggggaaaacaaacaaactcttggagtcttacagtgtcaatctgagtgcagtatttctctcttccacgtttgttgtaaagaaatattgacaaatatgaaatactcaggtaagagacaagcacaaagaacttccttataaatcatttgttttctgttgtatgtatagctttcagtgatttactgggatgtgattttaaacatgaagatttttaaaaatatatttgttaaataaatctatactatacctagaaatatgacgagaaattgctatgagacagtcattatacagattcagacttttttggtatatatatatatatatatattccttaaaaattatattaagatggtacaagtaaagtaaatgtagttcattgtgtctaagcattataggagcacatggaaactaaagaataactttctcgtgaccaacttatatttattttcttcagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggtaggttatatgtcagctctttgttctttgttcattaatctgagttgctgtaagacaggggaaaaatagtgtgtccacgtatgccattaggaattttgtttttaccaaatgcatcctgctacctctctgattgtataaaagcaggttatcattttggacatattcttctgaatagataagtcaaaaataggaaaaaataatttctatcaaaatggtcagtagatatttttactgtatcagtgttgaaaaacacacagtataacccagctaaccttctcttttcaatcttaaattcaaaaaatgttttatgagtacactaaagtttttgtaacaatttacttttttaaatttgtggcttacaaatatagtatttgacttagagagttaacgaaaataagtgaggcataaatggctctcatgaatattatcagaattgttttacttaaaagaaggtagaaatagaagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaatatgtatatgatggtgccgtaagtaaacacacacacacacacacacacacacacacatatatatataaaacattacagtacatgtgtacatgtagtggacagaataatggcttcccagagatgtccatgtcttaatccccagaacctttgaatatgttactttatagcaatatactttgaatatagcatatgctttgaatatgtatcatagcaaaagatactttgcagatgcgattaagttaaggatcttgagatggggagattttcctggattaaccaggtgcgtccaatgtaatcacaagagctcttgtaaaagggagagtgtagggttgagtcatagttacgatgtgattatgacagggatgtgaaagaagtagagagagggagagagaaagagaaagaagagagaggagagagatttgtagatattattttttggtattgaagatgtaagaagaagccatgagccaagaaatgccaggtgacctttagaagaaatacagtccttcagagacatcacttttaggacttctgacatatagaactgtgagataataaattttatattggtttaagtcactaagttgatggtaatattttagagtagcaacaggaaactaattgtacagagggaaaaaagtcatagcatattttaattacatcaatgtactttttgaaagaaaagggaaaacatattcatgatttatcacagtaatatctaataatgctgtacatgctttggacctttacttttgcaaatttgtcaatgacttggttaaaaccgatcattgatttctggcaactctgaaaagtctaggaagtccaataattttctaccaaaaaatttaatattaaataaataatattacatttggaaaatcatctgaaatgtattatggtttaaaaaaagctcgaattagttttgacaaaattttgagatactaattcttgcatttatgtagtagagtcataataaagaataattgtgcagtcattattgaaatgaaaaaaaacaaacgagttcttactcccaaaataggcaagtgtagctgagtccacataattgaggggttaatggtgtaattggaattgtccaattttatttccaggtagaatacaatacttattaaagaattaaatataaatatttgctaatttgaaaaagtcaataaaagctcagttgttaaaactcaacaataattgtttagaacttagaccaacaaaagatattttggaggaggaatattttatattttacatgttttagacttcccagtgcataatgatactggatgccactgtttttaaattctccacagaaaatataccccctttattacctgcaccagggaaaggcttcctcaagctttgtccctgttattccaatattatgtacaaattcaaaattgggcaattaattttaatatactataaatgtattaaaatgattgtgttttcacaattatattgctgagaaacatttttttacttctcaaaatgtgttaaattatacctttatcgccagtaaggctttggtttattgccctagctctgtgtgatgggagtgctcaaatcttggcattctgcatagttaggtcagttatggttctttccctcaataagaaatgcatactgaacccagaaacttcatgagttaatgcaccagttatttggaatttgtgatgcacaacttctttgataatttttgaaatatgttttttcctaggaaaaatcatatactcttaaaagaagaggctgataatgtgctatgaatatcatcatgcagtattctgcacactgatattctgaacttattcttgtcactactgtgctcttggacaagtaacttgaaatttatggcctctaattttttaaactagtaaaagaagaggattgtatatctcaggtccatttaaatgctaaataatttggcaaataatgtgcttgatagattctcagagtttcgtctaagttaggctagactacatggagaaatatggttagctgatgtcttagaatacattcaaaaaatcaggcacactcttaaagtagttatgagaggtggaagcaggggtctgttaggctgccattatcctatagtttcatttgggaagagctgaaataaattaacccatgttttagtatcatttctgaaaggagtgagactcatatattactaccattttctccgggtttgcatcgtctggatgagactcatatattgctatcactctctcctggtttccattgtctggataagggcagagatatttatttgtctctcttttgctgttcattgtttcagccactatcataatctgcatttctcaactgggaaattagcatttgccttttatgttaccattgctgaagcatactgaaaatgataatagtgtgttaatatatttacttacttacttactttaaaaattgtacttaattataaacaacaacaaaaaaaaggaattcattaaggtgtgaaaaatattccttgaggttcttgctctttctcagcaagagttaatgagaatagctatattcaaagcagagcaatatgggctaaggttctgaaaaactcagattacttccagaagttccccaggctttttaatttatatattcaggagctataatccatagtgaaaatttcacctttagtaatatcctatatgtgatcaaagaggggaacttccttttctttgcttttattattgctcagattttgaggtattttcaagaaagcctatgtggtttgatgaggagattaaaacgggaaatattatgagtctttttgagtgggaaatcagaaaaaaaattaaaaattgtgcatatatccacccctgccccattttcccccaaattcatatattatcttcttagcctgccatgcctccttctaattgattcatttaggggcctccccatcaccattcatcactctgagtgtgatcattactgcccaaagtgtgctgtgagatcgctgaatgactcagaataagctatttaattaaggaacctctgtttacacaaaaatagcttagtggagcaatcaacaatgatgtgaaagtaaatgctaaataagcttaagcaggtttaattaagtttggagtgacattaaattccttcatagttttcctgactgcagcaacgttattttaatgtggcatttactgtgtggtagatttttgaagttgcaggagaccttacttggtaagttaactgaacttcttatttcattcaaaacaatatttttaaaggctcggagtgagttaaaagcaaggagcaaaatcatagcagtttcattaaggaatgtctaaattgtgtgagcaggtgccgtcttgtctcttatttcaccataggtgataatctatttatctgaactgggaacatttctcctccttaatagcatttttggctgcattgcttctctcctgactgcctgtacttaaaagccttcttggtttctctttttcaaatgttgagtgcatattgcactttgaggactaggcagactcagcagtccgtgagctggtaggaaagcagcagtctagaaaaaattccattagggccagttggtattattttgctttgctttatgcaatttggtagaaatattatcaaatgactgaagggtctcattaagatgatttctatgtttagcaatgagttagtgtcctctttctttcatgtattagttcctcacaactttaacaacaagcattgtatgtggcagctgaaaaagggatggagggaattgtgctcatatttgtgcatattattaataatgtaattttctataatttcagttgtttctattttacttgtgggattaaatcaatagtgaattccagtcagtgagtgtataattatttaacagtgagtaactatttctgtgaacaaaacccaaaatgaattagtcatataatagagaattactgaaatacacactatacatgaagaatgtaaagataaagtggacatatttacaatgccctttaatatgaagattaaatttaaaaataattttagccatacacaaagctgttatatacattttctctcatatttactgatttaattagaaatattagggtatattttatttagtaattgactttaatgttacctttacaagctaatgctttaaaacaatattatctatgaatatcaaaaagcagtagtaccattaataatcctcaagtaacttttatcaaattataatgtacttacccataattagcctaaagtaaaaaatgtaacattgagtttttatggtagaagtacactactttgacatataaacaaaatgaaatttcctttttttacttctgttttctaatgttaaatgcttaagattcactctttatttttaaatttctcattatttggtgaggtaagagatgtagaattggtaccagtggaggtacgttgtttgtttgaggcagatgccaatgtttgtaaaaatagaaatcagtatgagaagaatgtcgttccctgttttattcaccatccatttctaaaattctcaatttatgatataataagtactgaaatattcatcattatagatgcataaaattgccagccttccgtttttcagctttactgaagtgaatgaatacatttgtcttcattagtttaacataatgcacaaaaattgatgcaaattattcatctttctgcaggtcagcccttccattaaaatgcattctattttccctttgcataagcagcacaattttaatatttgaagtgattttgcagggctaaatctagatctaataattttcagagactgaattaacaaataaactcaaattacacctgttcaagctgtacattcctggcatatttgttaagtctagattatatgtcactgaaaacataagcatctcaataagttatgcctgctccacagacatcattaacaggctgcatgctacaatctaggaggcttcaacagggaatttgatgaattgtgagcaccactgtgaacagccgtgattaatattgtaaatgttgaccaaatggtacccaaacaatgtagaaatggataattctcataaaacagagttctgacagattttatacacaaagattggatcatttaattcatttacttattagtccaagaccatggcttcaaattttactttagatcagttagccacagactgtcagactatgtcagatagttgtccttgggttagcagaggtgggtaagatcaatgaggagtcactcttattagaaaaaagctagtcaaatgtttgttctaaataccaaacccaaatgctttgcatttgctgaccctcatgtgacagacatattcatagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaattaaaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggcattatctgaacaagcaaaatggttttccatttccaaacatgtcttgaacttttagtaacagagctcaaaatgtattaggagaagtatcatctctaaagacatgtttagtaaacaatctttttagtaaacagagctcaagatatactaggagaaaaatcatctccaaaggcctgtatattttctttacatttgaccaatctacaagaatttcattactctttctttcctgcttagctctgtaaaataatgaacataaaatataaacataaatcatctttcttttttagaagaaagataaggaaaaacaaatttgacataaaatagagaaaaatgcaatattggacataaacaaatacctgttattagtgcagggacttagatagctggagcttagtgagaccaaagcagacagaccaaattgcaaaagggacttcagcaatacttaaaggatgggtagttcactgtcttgaaaaagatatatttttttcttccaattttagggttcttaatgattaatcaggataatgatttaatataaaatggtccaactcttataattctttccttggaattttacattagatttggaaaaaagcataatagtaaggaaatcattgctgacataaccattcctaacactattctaatgattgctgatggcaaaatcataagaaaggtagggtttataggataaaattatttctattttcatacttagtgtcagagtttcatggtttaatactcaagaaatatgacagcaaatctatttcaccagtcacttttaactaatatatatgaaatatgtcagaaccagtaaaaatagttggctgtttcattacaggttgataacattttctttttcacaagttagaggatatacagaatattaataaaaggcaactgtctaatacatatactctataatttgaattcttcattgatacattttatatgccatatataagcatctccctttatgatcttaggtacctgaatattttcctgcatattctataaatattccttcaattagaatgcgtttatattatttaaaaaaattttttaaactaaacagttataatgtgtatatttatgacgtaaaagtgacattgtgatttatgaatacaataaggaatgattaaactaattagcatatcaatcacctcagatacttttttatggtgtgaacatttgaaatttattagaatttttgaaatgtacagtacactgttactaattatattcaccatgttgtgcaatagatttaaaaagaccctgttcctcttatctgagattttttaccctttgaccatcatctccccatttctctcaaccctccagcctctgctttctgtttctatcagttcaaatgtgttagatcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatctttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttatagaagtataagaaattcatgagcaaaaatgataaggatacaaaaagagtaatttcatctttaaaaatatatcaatccataacattttaatcaccaaatggtgtcagataaaagtgaaccaatctttctgatacctaataatcttttcacattgtgtatctgttcaatcagtaccttgctgaaaattttctagtggtgctctcgagctatcagataaaatactaactcctaacaatgtcatgcaatccctttcttttacctatcttaagattcctgtattagtctgttttcatgctgctgataaagacatacccaagacgggataaaaagaggtttaattggacttacatttccacatgattggggaggcctctgatttatggcgggaggtgaaagaattattacatgctggcagcaagagaaaaatgagaaaaatgcaaaagcagaaactcttgatgaaaccatcagatctcgtgagacttattcactaccacgagaacagtatggggaaccacccacatgattcaattgtctcccactggctccctcccacaatacatgggaattatgggagaacaattcaaaatgagatttgggtggggacacagagccaaaccatatcatttcctttctgaatttatcccctcttccctacatctaacctgataacaatacaaacaagttgggtttccttctgcctgagtttaccttttttcactcttcctccaattttctggttgaattctctcatccaaataaatttcttatgctgaccttttcatctctttacacacttttcctaggctgccacagaaatatatatgatctctctcttttggaaccatagcacattttcagatattcctatatagtatttggtatataatattacaatttttaaagtatctttttctccattaagatgataatatgagtgtcctaatggcaaggaccataaatgaatcaatttttacccatactgtctcactattgttgagtacataaatattacttagcgtagctgtgagatcctaagtatataatggtgaacaatataaccatgacccctgccctgctagagttctcagtgtaacaaagactacataaaatttagcaagtttttacaaataaacaaggtaatgtgttacagaattatgtgacagatgaaactataataaattagtcttcaggaaaggtaagcaaaaaagattacttctatttgataacaggcgtaagaatgataactcttcttttacttttgctacctttttcttacttctctctcttctctttccatctacattccagttttggaaaggtgtacatagaaaaggaaaaagatagtgagagcatctcaaatccattttgttcatttcttctagatttagaggataggatgaggtacaagatatcaggaccatggaagaatttagccaactataaatgacactgttcatgtagaaatgagagaagagaggttaaaaatcatctggtatcaagagaagaaaaaaaatgtactaaagacatacctaataaataattatctaataatgcaaagaacttttaaaacacaatcataataaacaaccccactaaaaaatggtccaaagatcttaacagacacctcatcaaaggaaatacacacataccaagagagcatatgacaagatgctccatatcatatgtcataaaagaaatgcaaattaaaataatgctttatttaaaaagcaatgaataaaaattgcaagagtaagttgttacctatcaataataaccttgaatgtaaattaattcttccatcaaaatacatacagtggctgcatgtatttttaaaaagatcaaattacatgttgcatataagagattctttttagctttaagagtattcataactgaaagtgaagtgatggaaaatgtattccatgcacatggtaaccaaaagtcagcagggatggctatacttagagttcaagtgaaaaacatttataggagacaaagaaggtcattatttaatgataaaggaggaaataaatcaagaggacataataattgtaaatatatatgcaccaaatattgattcacctgaatatataaagcaaatattaatggactgaaaaaagaaattaaaataatagtaaaaggcaccaataccccacttttattaataggtaaatcaaccagacagcaaattaacaagaaaatactgggcttgaactgcacttttgatattgttttgctctgtccccacccaaatctcatgtagaattgtaatccccacattttaaggagggacatggtgggaattaattggatcatgggggcagatttcccccatgctcttcttgtgatagtgagtgagtgctcacgagatctgatggttaaaaagtgtgacacttctccccacaacctgcacccactgccaccatgtgaagaaggtccttgcttccccttagtcttcttccatgattgtaagtttcctgaggcctcccagtcatgcttcctgtgaagccttcagaactatgagtcaattaaaactcttttcttcataaatttcccagtctcaagtggttctttatagcagtgtgcaaatggactattaaaactttatatggaatgaacctaacaaacatatatagaactttccattcaagaacagtagaatgtgctttcttctcaactgtccatgtaacattctccaagacagggcatagtttaggccatgaaacaaatcttaacaaattcaaaaaggttgaaattatgtatagtattgtttctgaccacaacagtatgaaactggaaatcaataacaagagaaatcttggaaaattaacaagtatgtagaaattaaacaacatgctcctgaacaactagtaggtcaaataaaaaatcaaaaggagtgttaaaaaatatattgaaacaaatgacagtagaaacataatatatcaaaacctacagaatgcagcaaaagcagttctataagggaactttatagcaacaaatgcctctacttaaaaagaacgaagatcccaaatagcctgacattatgcctcaaggagctagaaaaggaagaacaaactaaaccctaaagttagcagaagtaaataataaagatcagaacagaaatacatcaaacagagaatagaaaaaccataggaaaaaaacccaatagtcacttctttaaaaaaataaacaaaatagacaaaccttttactaggctaagggcaaaaagagaggcgactcaaaatcagaaagaaaaagaaggcattaaactgaaaactctaaagcattactgaaagagattgaagacacaataagtagaaagatatctatgttcatagattggaagaattaatattgttaaaaattttcttcctggccaggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaatatttcttcctacccaaagctatctacagttttaatgtaaactctcttaaactttcattgtaatttctcataaaaaatagaaaagcaatcctatagattatgtgaaattacaaaaaggcctaatactcaaggcaataatgagcaaaataaaataaagctagaggcatcacaatatctgatttcaaattacactgcaaatcaatagtaatcaaaatagcatggtactgcccccctcccaagaaaaaaatagacatattgaccaatggaactgtatggagggtgcagaaatgaacccacactgtatggtcaattgtcaaaactatcaagaacacccaatggaaaaaaacagttcttcaatcaacggcgttgagaaaactggatatccacaagcagaagacgtaatttggtctttttctcacaacacatacaaaaatcaactcaaaatgcattaaagaattaaaagtaaggtcagaaattgtagaagtactagaagaaaacatagggcaaaaactatacaacattgagttgggcaatatttttttagatttgaacccaaaagtgcaggcaacaaaagcaaaaatagacaaatgggattacatcaaactaaaagtttctgcaaaggaaggaaaaaaaataatagtgcgaagggacaacctagagattgtgagaaaatatttgcaagccacacactcaataaggtgttaaatcaaaactatattaagaactcagacaactgaatagcaagaaaaaattatttaaatgagtaagggacctgaatagacatttctcaaaagaaaacatacaaatgactaacagatatatgaaaaataattcaccattgttaatcattggggaaatgcaaattaaaaccacagtgacatatcacctcacactagttagaatagctgtaacaaaaaagacataatgtattggagtaatgacaagctagaagaaatgtaatattattagtagtctacttcataaaaatattttcccagaaccaaagcgagcaactagtaccaaaccactacctaatgctaggtcatatacagcatgtaatataatataattacaatatctgaataactaatgaatataaaataaaagaaacaaatgtcctttcggaggtggccagagaggatatgtcatatgaaaaaaaagcaatacccagtaagccctttagacttttaacaaaatgtatgaaggatttgggttctattaaggaagaacaaaaagcatatttttattatttttttcaaaaattggtttcatcaattttagtatacagctatatttaaagtgttcttataactcttgtcccacaaaattatcttgcaaatagacttcaaagccagttgtggaactgtgttttaatacaagcagtgtgctgtgaattcttatgaagcatatggagcaatagatgaaaaagggaacctacaaaaaatacaaattggtaagctgtgagttcacaatatgtaagttcaaaggcagaaaggagagtacatagggtcagacagaaaaatctaatgaaggggcaacatattttccacagagagaacacatgtaataacaatagtaattgttatctaaggttatcttactttacaataagtattaatagtaattattgtttctaaagccatacaaattgaatttaaaagaaaagaatttatggggacattaataagcgagagggaaaaattcttccccgacaataaatttaaacattagaaacaagttttatttaattttttctgttctttcctttaatagatagatggaagcctttactttgctaatgtataatgtgaatttgcatgagatatatttgatatgtagtattaatcaagattatttgtacaagtaatcctttacaaatcaaacagatgtacatttaccaaaaacagaagtgcatgtgggaatagccagtttgggaaatactgttgtaaagagttttagaaggagatatattataaaaagcaagaatgattttgtttctgacccttgtaattgattaaagcatacagaagcttgatttgaaagtaaagaaacatttgaaaggctgaatgagaggtttccagaatgtaagataatgcaatttcagcatgttaaatataagatacattgatttcagtatatatttttaaatataggataatgtgatttcagtatattcattattggacaatttgctgtgcaacctttaaagaaaagttatttatcaatgaataagcctccctcagaattaaaagaaatgctgactgcatttactttattagtcctatattatctagacgtaatgaaataagataaagagaaaaatgttggcatgtaaaattgagagtttgtacagggtagtaaaagggctatagaagaaataaatcaatatattgtatataatagacttaaactttaaaattaagtatttagaactacgtgcacatttcattctacaagtaaggttcctagaatgatagagaggaaagaaaggaagaaggaaaaaagggggaagggaaagaatgatagagggggaagggagagaagagcacaggagggaagtggaagttagggaaggaaggggaagggaacaaaagaatacagggccccagcacggtggctcaggcctgtaatcccagcactttgggaggccaaggcgggtggatcacgaggtcaagagattgagaccatcctggccaacgtgatgaaaccccgtctccactaaaaatacaaaaattagctgggcgtagggtgcctgtaatcccagctgctcgggaggctgaggtaggagaatcacttgaaactgggaggcggaggttgcagtgagccaagatggcaccactgcactccagcgcctgggcgacaagagcaaaactcggtctaaaaaaaaaaaaaaaaaaacggaataagaaataaaaagagagtacaggaaaggcaaaaaaagaaaaagaaaaaggaaagggaacacagaggaatgaaaaagtagggagggaaaaaaggagaaaaggagggtagagggagaaagggagggagggaggacagaaggaaggaaggaagcaaggaaagaaataaagaagaaagataagaataactcaatttaataaacccagcaagttagctctgaaatatttggtgagatttgtgtttactgtttataataatcacagtttaatctcttaaggagttttaatctatgtcttgggagagattctcatgaaatcacaatattacataaaaatatttgattaaagtttaacataaaagggacatttagagacaataactctattgttgaggaagttctggatagatacatttgtagtttttatgtgcccatccatacgctgtcattgtatgtcacttgaaactgcctctatacctcctttgagggctcatttggagcatcaggtcttatacatctgacatatgaagaggtttcactatgtaataactgtatgtactatgactgcctgcttccctccctcccttccttccttccttccttccttccttccttccttccttccttccttccttccttccttccactctctgcaagctaggacttttttttacttggtaaaagggatcttttggcaacttgtaaaaagataatttacaaacatgagttccttactgtgaatatggagaatttgtttaaattatcaaagaaagtcccactgagagcagcgatatagaaagtaccaaagattagagattgaaatgaagattcaaggcctaatttggctttaaaagtgttgggtttatcctgaattttttaaaataatttatttgtcaatgttttaaatgtgtgaattttagacaaaatatttcatatgatctgacaaaaaagtgaaaatatatggtcaccctgtgaccatatagtctcacaaggttttagtaaaactgcaactgaaggccgtctattttgagtgttgcagttttccagatatttttgtctaccttcctccactcatttatggttgtctgtcctcctaacagtttgaaaattgactctaagttacaatgatgcatgttctaatagacacatttataatttccttagtgttttctaattaaagttagaggccccttgaaaacatatacatatttcttgaaggtgaccttacagtgtgactcctgagcttctctcagttgacattcagcaacatcagttctttgtttgccaacatacagattcatgtgggagtttgaacttgggaggaactgtctctatctacataattaatgagtgttcacttcattagagttaagtgcatggctgttcatgtcacagggagaatggaagattctttcgttctttggtctcaatgtgtccttgagatttttcatctagctgaaatttcagtccacatttgacttcagctggcatatttgtagaaatacttccaaaggagcatcaaattatgtatcaaataagtaataattcatttttaattacttgtccttttaaaaaatacttaaactagatcaatgatggaaggacaagtaaaacatgtcattgatttattggcattgattatattccttatattatttcatcttgtttaaaaccttaataagcccattaactttgtacatttgattcaaatcaaatatcatttaaacattcctatgttcataaaagcaagtgtgctgaggtttgctagcaatgggaaatttgtatattcacattcaatgctggaaataggaagttcagctggcgaaaagtcaagcggtgtctcacttgctgaaaagtaggttgcttttgtttatttgtgtcttattttgttcttgagaatgtaatggagaatatagtgtttgaagatactggaatagacatcccagtgcagttggtgcatatagtgagttggcaataatattatattctttcaatagttctcaaaatgagaaatgagctctcacaaaataaatacttaagtggattaagaattttctatatttgaaagtctactttccaagtaatcacccttcacaaatcttgcttataattatatttatataaaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaacaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttattgctcttacgttatgttaaaatgcttttagtcagttattatgctcctcagaatatgcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatggatggactgattggacagacagacagataatagatagcctccatacaaaaaagcttgtaatgtatttaggaaaatagaacatatctcaacaggtaaataataataccagggaacctaggctgaatgcccagtgagtgatcaagacagaaagtagtataagttgggctaatatattgaaatctgaagtggttaaggggcagaatttacactgcaccttcatgttagattagtattttaagaagagcacaggggagaaactgagaagcagaaattcccctaatatacttaagaattcttgcataatgaaaataaaatatttgagttctaattataggaatgggcaatgcccctatttaggaaggctgtaaaaaatgtagagaagccataaacttctacagcttttaagtagagaaaagatgatgttaaacaacttttcagttgagtttggtagatcttcatttgtccaactttttaaacaggttacttacattctatggttctcgtctttctacttttacattgcctactctcactaaaagagatgtatagatgtggacacatttaaatcaaaacaaaattacaggcaatgttgaatacaagctgaaatgtttaatatttttctggaagcaggaaaacactatgggtgaatttgtacacaaaaaatggaatgtgcagtatagtgtcttaggaaaaagatcacactttagaagcaggctatttctgggtgggggaaaggaataaaaccaatcccttggaacagatatagaaaaatgcatgtgcttcaatatttttatatgtttctggtcaatgaattagcagatattacttatcatgtaatatctaatgcagatgagtatgtacctccattagcataaacaatacgttttatttatattgttgcctccactggaaaaaaacaaaataaaaccttgtctcctataaaataaattgataaaggaacaacgccccaaatgtttacaatacgtggctgtatgccccttgatttataaagtaaatcaccataatgatttttaaattatctaagtccatacaacctgtgacttctgttatgcacatcacataacagatactagtgactgcccattatctgctaagtaaaagataccattgaatacagcttattagtaattattcccttaaattactgcatttaatctttggaaacaccaatttttcacaacttttctggtctaaaaatagagatagctgttttatcagtgctctggtttcagtgtagaataaattgtagatatgaatgaaacatctttgcactctatccgttttcctttgtggattctttcttactgttttacaatgctgtaagctgagtccaccttttaggagacatattctttcttaaaacaaaattcatttaattcctcaatatctagcaaggctatccattttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcctttcttaggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggtaaatgttacttgtttcagtttaaatttaaaacaatttttgttgttacaataaaacacaaaccaaaagagtttttatgttaccaactaatgataatgcatagaactattgctctaaattgtcttatgtcattcattacataacaaaatattatattttgtgaaatttcacagaaagactcatggtcacctttatgattttttatttaattttaatatgtttaattgtagccagcttcaggaaaaatagctatttctactcttattacagacttaaaaaataaacttttgttgtttgaatttcatcgtggtatatgatgagatacagttaattaagtgagtaaaaattagaaactaatatgaaagaaaaaatactctgcagattaaaaatgaggttttatatacaatatgggttaacagtttcaagttagagagtaagtttttatctgaatagctttagtccaataaatttctagtttaagaaagatattagctttcactggagaaattacagttaattttctacattaatgagtgtgtgaaaatagtatagtttctttttgccatttaatagtattcttaatcagttctttgtttttttgtaccagagtccttctaaaaatatgtataaacttcaaaaatattgaggctattgctatattttgcatttgaatgcagtcatttgtataaatgctttttgtattatccttgaaaagtttgtcacctcattcagattctatatttctagtgctataatttcctcatttttataaatatgatgaagactaggaaaataactctttcagatgctacatgatactttttgtatgcaaattcattgctctggatatgacaaaaccaacagtttaaagtcttctagtacattatttaatcttttgtatgtaaacatctcttttgtttttgaagaaactcacaatattttagacttaactttaaccactgtggcagagtgagatgatataatctttaatatttaagaggtttatgaactttagttggtaaatacaaagagcgaaaaagaggtattttgaaaataatgccatacaggaataccaggtaaatattttttctaatattctttgaagtgtttgtacctttagaaatatttttgaaaataaaaatgctcctttatctctaataacttatgtcataattatttatccttcctggaatcagaattttggatacagtatttgtacatttttgcttgattacagtacttgacactgaggaatgttatcataaatgtatatttttataaccccattttgtctatgactgaaataacaaattaaagtttttgaagaattcagaaaataacatgatttgttttcacaacacattcaggttgttatttatgcttgcttggctaactcaaatattggttgcatttgtgtgtctaagtacactttttatgttataatcatttttaaagtgtcaaaatgaactttgaaactaaatctaaagagctaaccaaagaagaaatattaactcattaattatcatttcaggtttaatttgtcagtaaatgtggtatttaaggcattaatgtgtaatataagaatgaaaatcatagaataaatatgggttttctacttggaacctcaaataatccatatgtaataattttctttaagttatagctcagtattaaagtaaaacgaattagtctcttgatgatatgtggtattctattgtgcttacctctatgtgtcccattcatttgatttagctaggccgtatctttagtgcagttttgttttacaagtatctggttaaaacaaaaacaaatgatgcgaggatttaattttgtaacgtatcgtgcttcattgttattacgaacacgtttagttgaatttttcagatattacccagatctcttgacattctatggatctatatgatcctctaaaaattagaaaaataaaattaatgtaccttttcaaacggaaacaatgaagcattaacattgcactagaaagaaataactgagtggatattacatgagcattatagtcacttcacaatgctttgcacactgtttctacatagctgccacaaagaaatccaaattccttaggttagcagatgagaccctttcacacctgtccctgtccactgctgtagctttatcttttgctcctctccaatttgcacctttactacagccacactacattttaactctcaatttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagattttcatttcctattgcaatgaaaaaaaatgtgactcatatatctcatctttatacttagtttatttcaggtactgtcataatctaaaaacatgtatctccttttgagaaagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattttttgtttgtatctccaaggcctcaattagtgcctggtggcataatatctatctacctatctatctatttgtctatctatttacctacctacctatctacctatcatttaaattaagaatgaagttgattgcagtaactttttaagaaaagtatcataaagaaacaaattatttttctatacaattcaaaatagtaaattaaataattatggatttaatggaaatgattcattttatttattctgataaattaggttcttgggctcagttcttcatttttcttaagaaaatttaggttggtctatatgatctatatggctgtttaacacattacttaatttattaaaattagccatacgatagtcctagattttatcatacatttgagaacatacagaaattcagtttacttttacttatcataattgtgtctttaacctagatgtcttatatttcaaaaataaggtaaacacttgtgagatccattatttactcaataaatatttattgataaataagtctacaatgaattgtgttttgcccattgaaggaaagcacgaatgtattggtgactaaatagtttgtcagatatgtcagatataatatatatgaagtttagctgaatgtgaactttgtgaataaaatttataaataatgaatatctttccatattaagtcttacttttaatgatgataaaattataatatattaatttatgggtgaaaataaaatgccttttataatacatattgtaaatactagtgaaaacaaatagctcttgataatgataggctttctcataagttgttggataaagattaatatgcaaagtttcacatttttaaatgagggcaggttaaaaataaaaacagaaaataaagctgaaatatgtggaccttcaagcatttaaaaatggaaattgcattcctttcagataaccacaagatggtgtatcataatttttataaaaaatggctttaattgtgatgtaaatattaatgcctcaaggacacattgctttttatttattcaaacttttaaaatactcagaaccttttctcatctgaatgtgtctgaaaaggtaactaatcaacacatgcattttataattatttttctttttgccttatctcttctgtgattttaaagatatttctactgaagtttcactgagaaagcaatccaagaaactgttgtgtatctgagacaattatcacactttgggtgtatggatttggttgaaagatcttgtgtccctcttctaagacttacttttggctataacaagctgcttaatatactgaattttgttgttttctctgataatatttataatatgttggctttgtaagcaagaattataagatataataattttaatttttataaactttttataacatggattgtttaaaattctgcatttcttaaatatttgcatatgtctacttttaacagacatacataatttttctttttttaggttttcagcaagaacagcaacataacttctatagtttgatctctttttgtgtgttttgtatatagaaagaatatttttcccatgtatttgaaaatgtatttgcttatacaaattgtttttattgaactgtctggatataaattattgagtttcctgacataaaaaaaatcttaagatgaagccaaaagcactccatttcttattaagtgtaaattaagtaaatatgtctaagaaataaaatatatatatatataaattattgctcagatactgaatttgtgcaataggtgtcccatcttgaacacacatttttgttgtctttaaaatggttaaaatgtatttttaaatctatgtggtattgttgtttttttaggacatagtctactttggtcaatgtagctgtttctattatagaacactggcaaattttacctaagacaatctctaaataattatatttttttctggtgcactgatagttcaaaaacattttgtgagggaacatagaatgttcttcagtgtttagaggaataaccaatttggaatacagctataaatcagagtagtagaagcacaaatgaacaaaacatttcaatttgggggatgataagaagaaaatcagagggtttagtttaaacacgcaagactagggatcctattttaaaggtcatttataaggaaaacacgtagcaaagccaactaattctgtatttcatggaaacagaagaatgaaaacaggttgtttacagatagctacgtataagctgctgttaaaattttaaataattagttctaacaggagcaatgctttttagaagaatatacttttggggtaaggtataggaatgcaaacagtgttataaattatcagtaaaaatgttatgtcaatatttatgttttgcccagtaatgcctttttagaaactataagatatctatactttttattaattacatttgatgtaagaaattttagctgaacttaattttacagaagttaaaatttctaagtaaattttcagtgtaaaaattatagctgtaaagcataattatataataatatcatattactttttcttaaaatgcgtttcacagctatattgactaaagttgtgttgattcttgtcagaccttatgtattaattttttaacttgttcttcacaagttaaaaagtataaataaactttggacaaatgtcaatttttttattgtttttatatcactgcctttctttgagagctgagtgtctttcaatttccatgaatgatctatataatgactaattggatgaatttttaaaatgtcttgatatacaaatataaaatactgtactttgaaatgaggtgtcaatcttcattttgcttactgatctacttccaaatcagctaaaggatttttaggtcatttgtttatgataacccatactctttgtatccccacaaataattatttttaattaaaataatagcttaatagataattttaccaccttatttttataaatgactttagtttttaaagtgtaataccacatttgaatacaaaactaccctaagagccatgtaaatattatcatctatatagtacagatgaggataataagtatctcaagggtgaagttgttttccaagttcaaagatgcctagtctaacagtgtttcaaccatatcaagctgtacagaatggaggcagaatatttaactattcttcctccttgaatttttcactaaggaaatatatggattaggagtttgaattagataaacagattatgggctttggtcataagcagcctaataatttcaccttcctagatagtaagcatgagttatggaattaaaaagacttggaaacataactttgtttaaccttagataaaattacttagcctctctattcttctttttaaataaataaataaatgaaacaatgaataaacaagttatgaatccataaaaacggtgttttaagaattaattaagatagttaatatacatagagggcttctttgcacataactggcttataacaagcagctcttttaaaaataatatcattattattatttgtaaagctgatacattttaactgccacaccttatgaaaagaaagttttctagcttaagcattagttatttggatgtaactcttaaaaaaaatcgtatcattatgactactagcaaaaatgtgatgattagtattattttttctaaaaatgcatttcacagctatattgattaaagttgtgttgtcagaccttatttttttttttaactagcttaagtaggggaaatttaaaagtgtataatgatcctcaatttttctccatcccattgtgtttgcaaaatacaatatgaggatattgggtaactgtttctgttagagtaaaggtttctgagaatattttaatatttgataatgtttatcattgtgaaataatccaggctaaagcataacatgatttataatttaattcactaagaaagatatgtatttcttttgccctcataatttttttctgtctgctgtataatttagtattcaaaaaatttacatttagcaagaatagagtccaggtaaaaagctcagctgagaatgaaatcatcattaataaggcaggctaatatgataaagctttcatagatggaagttaagataatagagttcctgtcttagctctgagactagttagatatataacttgacttcttaagttttaattttttctagctataaaactacagtgatcagtaggatcacgaaagatgctacatgtaaagtttcttttgactgctgaatagcttatgtaaataataaaacttttttttaaagatagctgctctaaaaccaaatatcaagaacaaggttgtatatatttttttaacatgagtgatttagccagtcattttccatctttcattgcttcactgttatattcatatagccttaggtcaattcatacttctgatgtatagcattaactgtttgatgtttttaaaaggctgccaatcaaaacagttatattcacaagaaaaaatttaacgggtcacattaaatgacatttatttttgttatttaacacaccaatattatgtaaaatattatatcttatatcctatgaatattttttccattttagttattattattatctaatgtggtagaataattttctgcaactaatcacagtgactgttttgatttgtttccactacatgtgacttactattcttgggcaaatggcctatagagtcagaaattaattggagagtgtctaagaatatatagtatatccataattagttaacaaataatttaaatgacaaacacaaaataaaagtttggttgatatgtactagaatatattagaccactgaggtacaatagtatcttatagataccattgataggagtagctcaaattttggtaggctccaagtaggataagtagaaattgtatgtagaaatggttaggaattattctgaatgaatactaaaatatcatttagttattttatactatcaaaattaggccagcgagatacacaaaataggatttcctccttaaaaataaatactaaatgcaggcttgaaagtaacatattttatgatatttcttgaccaatgaatacatatattcaaaaagagagtgatgagcataaaagttaaatcatgctggttatttttcttcagatactgtttttcaaaaataagtatattgctaaacataatggttttaactttaaaatgaagctacatatgtcaattatcaatgtggagcatgatttcaactacacttctaatataaaaagaaatctgtgcttctccaaatgctgtcacatcatgttattataaaaatatatcttttaattaggaagttaagcttttaagaataaatattctgtaacatcaacaatgatattcttgaaaacatttacctgtggactatttatgtattttcttattacatccaaaatacaaaatagagctctttaaaaaaaaaaagctctataaaaaagcaatgtaaatatggccaagttcatactatcaagatttccagatctacattgtttcaagaattagagatgtgtaaatataaattgactaattaaatataatgaattttattaagagttttactaatttaaatgcaattatacatgctaacagctcaaagatttaaattttcattttcaggaatcttctatttggttagtgccaccataccatccagacactgtttagtaatcttttgaaacttactaaaagaggtttttaataatggttagtatccttgtgcctttcttttttctttttgtagtctgttatattaatgtggagaaacatttttattgttgttttcatcctaaggaactgaccttatttaatgacacagtgcgtgggtttccacccctaaatagtgattttaaaagcaagatagttgtctttctctttcttcttccctccagctttccctttcttcttctcctccttctcctccctctccttctccttctcttctccttctcctccttctcctctccttctcctcctccttcctttcctttcctttctttcctttcctctttccttccttccttctttctttctttctttctttcctttctctctctctctctccctccctcctttctttctttctctctttctctgtccatctttctttctctctttccctctctctctttctttctccacttcttttcttctttcttctttttttagtataaccaggaaaattactgcctagtgcacttgggttttgagacttatttcatagtccaataaaaagatttaaaataaatttcaatcattatataaagtataaaagacaatttgtctctacttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaaacctttaaacaaaaagaaaagaatgtatatttgctctagtaccataaatgaacagttctttgtgatatccttgaatttgtttaatttgccatgttaattgtaaaatcttgctcaaatctaaagattatcaagttttaaaatgggttagaattattctacaaatgagaaaagaacctatcgtctcacagtaactttatcaataacctaaataaacctatttttcatgtaaacttacattgataaataacaaaagagctggcaaaattcatcttattcaaagagaaaattaataaaatttgtattttgtcattatgtaatcgagaccattgattgacttatgaaagattgcttgattaaatttttactttctaatggctttgtaagctaaataaagtctatgacgacaatggtgatttacatgtttacaattttgagatagttgtaaaatttgtaaatataatttatttaagacaatttcaaattataaaagataatactattctggtaattgattagaatgggcttttttcaatttacattatctattactcagcaatataaacttaatattatatgaaattgcttaaaatggttttaaatgttcttatttgtagtctgaagtaagtatggggtactaaacacagagtttacctcttaaattgctagaaataatattgagtcatttcatagttgagcttgtatgcacatgtgtaagattttttcctaagaaagttagttacttagcctactcccttactataggcaaattattaattaacatttatactctattctgttttgaaagtaatgtaaccaaaatatctgaaaattgagattgccaagaagaaggtgtcataaatttttgaagatttgggaaatttattggttttaaatgaaggtttatttcaaacgattcaatgttacacgtcctataacaattttaaatgtcaacgggatcaagttttgaccatgttatgtcatctaattaattcttctgttaaatgtttcaacagagagccaagactaagttacctcaagactatgtattcctccctattttggagtcagtttccatttctacagtgttgtcatcatcaccatcttcatcatcattatcatcatgttcttaataagtacatctaatagtaggtattaagcaacaagaaacactgtttccatatactggctgtcaggtgccacataaatcctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatattagagtcctgtgtatctattgttaattcaatcaacatttaaagagcttatgtgtgtacaagcagtgccgtgagaacttgacctctgctctacacaattcagggagagagatacatagagcactggcaggccagacagaaaaacaggataatgagtggaaaatactgacagaataaaacaaaatcaagttgtgaaaacaaaagaatgtgcctggtcaagtggaaagggcttcctaattaagttaaaacttgagccatgtcctgaggtaggggataaagttgggatgatgtgaaagatgaaagaactcagcagggtaccagaacaaggagaaacaaaggaaaaatattaatggaagtcccaccaataaagggagtgtgaggagaaagagagagagatggaagcagtggggaagggagaagagggctagatcagagaagtcatgatggaaaaaaataatagatttgagtttgacttgtttcctaaaggagaaaatgctattaataattgatattttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagatacctaattaattcaaagtatgtttagactggcacaaactgttatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcctaactgtaaatatgtatcggaaaatgacacacatatggtcttaaatattttcatcatgttgtcttagaaatagtctaagttcataatcaataaagcagctaacgcacaaataagtcttcacatgtatctcaatcagttggggagagacactaacaaaattttgtttcatatatatgactctacaatataaattttgaggagctgtaacaataagccccagataaacagaggttctagcaaatctatttccaatgagatgggaactaagacaaaagcaacatagggtcatattttttctcatttgataaattatcagctctcagttatcaagctaatgatgacaaaaaagttaatatttgtttgtagatgtctaacatgctataatttgtcatttcatgattaagtcatatttgtttgtaatcactgtcaatgtttctataggcataatcacaaaaaagacataatgaaatgccagaaattgttttccatattttatgtctgtgtgagtgctatctttgttttgagatgtacaatgaagaatcaatgttcaaacaacatttgcatatctcatcttgtgatctgaaaagtagtatgatttgtctatttttttgtatcaagaatgggtttctggtatagaattgtcattgtatttaaattttaaagtagatgtctatgtcatgctaatcatttttatataatgtcataggaaaattttatttaatatatgtgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttca

SEQ ID NO: 1408 - DNA, 671070 bp, Homo sapiens; identical to SEQ ID NO: 1407

SEQ ID NO: 1409 - DNA, 671070 bp, Homo sapiens; identical to SEQ ID NO: 1407

SEQ ID NO: 1410 - DNA, 64297 bp, Homo sapiens
ttccacaaacaaagatggtttaatagatttcagcatgtttccacttgacaatgttatacgaaaatagaatctttattaaaatagcaaggcataacaatcactgctactcaggaaacactgtgtttattctttttaatcatcaaaatcaatgactttgggcaagacctgtgaaatctcagagcctgtttctccatctggagaacaggcaggtagggcattgccagctccctgtgagtgggggccactggtgggaggagatggccctggtcgcccatgggatgagaaacttactcctgcttctgtccctggagaaggtcagggagatgccagtgtggccttaaggcaattctaacacttgcttatctcgttttgtaacagagaagagagagctctcagccttggccacaccagcatggagcccccttccccagcgaatttatttttcatggtcactttctatttttggcagtgagtgatacatgttatccactattggcagcaattggggggaaaaaaagttcattttaaaaacaaagtttaggccgggcatggtggctcatgcctgtaatcctagcactttgggaggcccaggcaggcaaatcacgaggtcaggagttcgagaccagcctgaccaacatggggaaaccccgtctctactaaaaatacaaaaatcagttgggcgtggtggtgtgcgcctgtaatctcagctacttgggaagctgaggcagaagcattgcttaaacccaggaggtggaggttgtggtgagctgagatcgtgccattgcactccagcctgggcaataagcgtgaaactccgtctcaaaaaaaaaaaaaaaagtttaaaaagcgagtctgtttaaaggagaatatttggtaaacaacaatattaaaatatagcaaataatagtaacaataatcacaatggtaaggaaacacttcattagatcaacttaagagtattttattcttggctgggcgcggtggctcacacctgtaatcccagcactttgggaggccgaggcgggcagatcacgagctcaggagatcaagaccatcctggctaatacggtgaaatcccatctctactaaaaatccaaaaattagccgggtgtggtggcgggtgcctgtagtcccagctactcaggaggctgaggcaggagaatggtgtgaacacgggaggcagagcttgcagtgagccgagatcacgccactgcactctagcctgggcagcagagcgagactccatctcaaaaaaaaaaaaaaaaaaagagtatttcattcttgccactgagcttaaaaagaaagaaagaaagaaagagtattcctaacatatgtccagtaattttgattcttaagcaagggatgaagaaatacaatggcatccaggtaacttcctaactagcgcatagcaggtagctaacccactcatctctccctcttttctttatagcttctattttttttaaagagaaaaataacgattaaaacaagggcaggtttaaataatcgtctcctgagctgcacttcagtatctcaggtaacagctggagctgcctggtgggagcacatcttttccttgagtgtaattcactaatgactgtggttccaaggaggtgcgacctttaaagggaattggcccttctttgaaggcaggtgagaatctagtctcagtgacaacccagcctgatttggaaggggggagtcataagggttttcgcccagcacaccagggttgcagcctgcgcaagaccttccatagctatttctgccggcttgcttccttcccttcccagccacgatgaggcagctgagggttgccacggaaaccggctctgtcctcccactggaggctgccagctctgatttcctgcagagttaagaaggaggcggcagtgggggtcacccaggcgtgaagatgggtttccctggggatatcctgcctcctgccaatcacagcgtctctctgggaatcctgggggtgcctggaggctgaggcccagggaagcccccaaaccccagtgctgctctgagaagagactagcctctgggacattcagaggtctggggttcttttatctccctccagctaaagctagagggacctcattatgtgtcttacaagatgtacccaagtttaggtgcctctggctctgtcagctcctgaagtcgagaagaattgtcccatcaccagtccccttgagcccaaagaacaggagttgctcatccagcatttgctcctgggacagtaaatctgcctgcagagttctacagcttatgagctatgtggccccaggcaagtcacctcacctctcagttttctcatctatgaagtgggcacaaccctccttctcttcatagagatgctgtgaggagtagacatactgtctgtagggtctctcgcaggcatttaaagggtctcaataaacaggactttatattaataaaaatagcatcataaaaaaggtttgcaggccatttttctctttaagctgttttttattttaattaattatttatttattgagacagagtcttgctctgtcgcccaggctggagtgccgtggcgcagtctcagttcactgcaacctccacctcctgggttcaagcaattctggtgcctcagcctcctgaatagctgggattacaggcacgcaccgccacacctgactaatttttttatgtttagtagagacggggtttcgccatgttggccaggctggtcttgaactcccgacctcaagtgatccgcccacctcggcctcccaaagtgctgggattacaggcaagccggggcaaaggcaaattttcatcactgatacatttgttcaaagggtggtgcactcaggctgggttggaccaattagctggtccccaccacctcttacaatgtcacttctaagagttagaacagggtctcacactcagatgccttcaggtccaggaggcgctgtgaatgcagaagcagacccggtcagaaccctggtgaagccgagagcacatgtcctgcataagggaggcggctgccactcagctctggccaagagttacccttgggaatgtgagcccagtgtggccagatataccaagttttcaagagaagctggacattttgaatgaactctcccaaagatgataacaactaaggcatttttttaagtgaagtccaaacaaaacacgtctgcagactggatcgtgatcacagttggggcttctgcactagaatgcatgaaatcggcaccttcttttttggcttgatcagtctaaggagtcctggctggctccttccagccatcttgtctgggctgtgtcttccttagctccctacctgagtgctgacactgagaaagcccatcccatctggtgcctgtcactctagaacagagaactccactcctcagagcccagtgtttggagggtgcccctgttctgcaccgggaatgcatcagccttgggggaagctctcctgcattttctcaagtagtgtgagcaatggggcaatctggcaaatggggccccagggaagcagatcttctaagggactcctttggttttagctagtttaaggattattgggggactgactgctgaatgacatcaatggacacaaaggacatcctgagtggcctttctgtggccagcatccgctttgactggataaggcccgggccatgctagctcataagaactaggaaggtgacacctccgggagttgggggcagagcagtgaagactcctagttctgccttatctgaatagcatttgtggatatcacgaggtgagagtaacgaggtgaattgggagcagacaaagcctgattttggaaagaaaactttgcagtggataatccatagagctttcaatgtcttttctttgttcaccctcttagcttttccctcccctggacccagccttctgggagaaaagcagggaagtggtaatgctagcacctgcacccgggccaactgtgcacacagaaagctgggaggctggggcaggctggggcaggctgggcagaggcgagcacgtggatccatctgctccctgtgtcatgggcggatgcggtagcggacgggcacgtcgtgttccggctgcatcagaccgaagccgtacctgctgaggtcaaactcagggatctccacatctgcgttgatcagctccaagtccaagtgcaccagcacaaggaacacaaatctgcagagagatggcatggaaggtgtgaaggagaggagtagggcagggggttatcgggaacaaggcaggggagccatggctgcctcctaagtctgactccaactttgagtaaagtgaggagaggagtgaggaagtagaagaaacgcatttgctgctcaccacatttgccagccccctgtaaggttaggcaggcccgtggatgagttctggtgaatgggctgtgtgcagaagtggcctgtgtcactcctgtgtcaaagcattcgcgagccagtgtgtggctctccagctgtccctcctgcctggcagccatgcaggcttcacattgagacggtggagccgaaagagggaaagagcctggcccgagtctgtgcacagagtggggaagccctccaatcccacagctgataccgtgtgagtggaactacacctctgttggtaaaagccactgagactcggcaggtgcagagctgagcctgtgctgattaatacggcgactcctctggatcctccagcccacacactttgccgcctttccccacactcctggaaccctcactgtctatcttggccaggactgctgctaacccttaggtgtctttgtgagattagaaacaggcatcgctctcaagacattttactgccatctctgagaaaattgtcctaaatagaccaactttgcaagaacaagcactctctactgccatcttctgggaaaactgtcataataactattcgcagctgccatgcctatgatgtaatcagtgcccccataaatgtggaggcagccctacgggggatgtcaacggttgctgcctccctgcctcatcttaccaatgcccatgttcgtaagggtcaggagaatatcttatgactcttttcccaccactattccctaccccaacccaggcgcccgatgcagcactgagcacatggtggggattcttttgtctcactgaaggagtgaagaagagggcagatgaggagagaggggagttaacactctggacagatctgggctgtgccgcttatgggaatgtggccctcgccaagttcttacccactctgggtctcagttctcccatctggtcaaagaggggaaaggcatgttgagtctcttccagctctgaggctgtaggaaactagagggtgagtttctaagggatggcggttttgtgcccacccctggatttgaactcctgcacctccacttcctgggaacacggcaaatgatctgacctgcctagactcggttttagatggaccagcagggttgtcatgacaattcagtgagataaaaataacaacaaattagctaatttattggaacactgtgcgctaggcaccatctaagcatttagtacccgctatctctttttatctgtccaaaaacttgatgaggtaggaatgccagtcggttctgctctaacacttgttttgaacaggtgaatttgttccaataggattgatatattagggcaccatttgaatataatgcaagtttcacatttgctcacgtgcaatttcacttgtgagaaacatgaggtgaagacgaaagactgcacccagctgaacctgggtgtgcagaaatccataaaatatacacatgcacacaactaagcatcgatctacagccacagttattacagcacttacatagttcttagccaggtaacatgtataaaactttactaccattttttttactgggttcttctctctctctcttttttttttattatgtcactgatgaggtttttgagtgttggccccagtcccccttttccctcaatccctgcagttttttctttctttctttcttttttttttttttttttttttctggagacagagtctcactctgtcgcccaggctggagtgcaacggcgcaatcttggctcactgcaatctccacctcctgggttcaagagattctcctgcctcagcctcctgagtagttgggattacaggcacgctccaccacacccggccaatttttgtatttttagtagagacggggtttcaccatgttggctaggctggtctccaactcctggcctcaaatgatctgcccacctcggcctcccaaagtgctgggattacaggcgtgaatccctgcagtttttgttgcatgatttcacacagcaaggtgattttaaggaatgcatatgagctgtattatgttcataattgactccattttcttgaggaaactgaggctaaaggtttatgtaacgtgcccactcacttagcacaatgcatgcacaataatgatattaacaattatggtaataattaacatttttcaaatgcctacaatgagccagacagtgggttaagaacttagaaagatccaattcatttatcctgacactcctggggtatagttataatcagaaccctcattttacagttgaggaaacaggctcagaaggtaacccagcttatgattgcacaggggctggacaggaggacagggcagatgtcataacccctggtccaatctgtttgtgatcctggtggccaaagctcctggggttcaagggagataatttatgaggctctcggccccacaggtattaaaataaccaagtgggaacagtgaagttcggccagttcctaacatgaagttctgaacatgcggcagcagctgcagacgggtagctacggtcagctgaaaggaatgtccagtatttggaatctggacaccagtcttggagggaagaacctgctgccagatctgattatttcaaaagaaatccgaaatctggcttttttacacgagctcttctgatttataaaagcacacagttgtaaaaccacaaataagagatggctcacgggctgtccatgtgaagcctctgccaaaccattctcctggctgagccctcagtcccaggagagaagggcgcctgccaaccaggggatcaggagccaccctggccctgccctggccccccactcactgtttgatgctgttgaccgcataactcctccccaggcagtgattgtgccccgccccccagggcatgttgtaattcttcagccgtttcccatccttgtaaaagtctttcttctctgatccgtcagggttcaggaatcggttgtatttaaatacctgaaataggaagaaggtccttttctgaccccattcccagaacaagctcacaccaagaaaaatgtatgaggatgttcatgacagtcatgtttataagagggaaaaactggaaaccatatacaggtcaattgataggggattggttaaaaaattatggcaaaaggtttgtgtgtactgacatggaaagaatttctacaattggttgttgagtgaaaaaagcaagtttcagaatagtatatattgcatgatcctatacacacaccaatcttttcatggcatgtgaatgtgttgtgtgtatgcctgtaaagccatgaaaacaattcgcaaggcacactccaaaccttggtcagagaactctgtagaactggagaagaagggaaatacatattttttacatttaagtatatatttctctgtatttctttatattctatgatatatattacttttgtaatgtaaaataaaagaaattaaaatattttttaaaaagaaaatgccaatttcctttggttacactgcacagtggtaaggcaagggttgtagctgagcacagagcttggcatggagtagctgccgactgaaagatgggtggaaggataggtgaatgaaccagtggatagactaagagatggaaatgtggatggaaagatggatgaatggagggatggatagatggatggatgggtagatggggtggatggatggatgggtagatgggtgaatgaatgggtagattgatgggtggatggatgaataaatggatgaatggacaaatggatggatggatgagtagatgggtggatagatggatggatgggtggataagtagaagaatgggtggatggacatatgagtgagtgggtagataaatgagtgggtggatggatggataaatgagtagatgattgaatggacagacggatggatagatggatggattcatgggtaggtgggtggatgaaagagtagcttcatgggtggatggatggatggatgggtggatggatagattaatggatgggtagatgggtgagtatgtggatggatggatggatgcatggatgcatgggtggatggatagattaatggatggatgggtgaatttgtgaatggatgaatggacagatggatgcatgggtagatgagtggatggatggatagatgagtggatgggtggctggatggataaatgaatgggtagatgggtggatgaaagggtaaattggtgggtggatggatgaatggatgggcggatggatagatgaatggataggtagataagtgagtgtgtggatggatggatgaatacatgaatagacagatgcatgagtagatgggcagatgaatgaatggatggatagatgagcatgtagtttagggtctgacacacagtaaacacccaatctgttagcaattgtgaaagtttacttcttctcaaagtctggggcaaggcaaaagtgttgagaaactgacattataacaatctgaaataaggaaaatggctgagctatcacaaagcactcagtgtgaatgaacatcccctcatgttctagggttcctcagagacccttgaacatgaggggatctgggtctgactccaagagaagctgtgaaaaaaggtaggagccaaagagatatcagaaggctggggagagagtggggccatcaatatctgcttatgcatgatcccatttaatcttcctatcaatctcatgaggcaggtgctattatgaggtccatttcacaggtgaggaagcaaacacagagaggtgaagcaatctgggcaatgtcacatagcaaacaaagagcagagccaggctgccactcagatctggctcatcccaaagtcactgattgttctcccacagaccccatatgaccaggcgcccctgccatttacctctgggtctgtgtagatttctgggtctctctgggggctcaggaaggggaagaggaggaggcggtcaccacgtcgcaggttgaattctcgcccgtctgccatgggcatggccaggtccaccacaacctcgcgggtgatgaagggggcagctgtaagcctgaggctctcactcagcacgctatctgcatggggcaggtgcaaggaagagtcagcgggctatcccttcacctgctcatatgccaaccccagctcttattttacagaggaagatgaagaggctcagagagggtgcctgcctcgcccacacagtcacatagcaaggtgaaaaaggacacacgatgacatgtggtctctgtggtccctcagagacgtttgaacatgagggtatccaggtctgaccccaagagaagttgtgagggaaggtgggagctagggagatatcagaaggctggggagagagtagggccatcaatctctgttcctgtctgcccggcatatatttctcttctggaaacgggcccctgattttcctctagggtccacccctctctcattctcaggggttagactgctgcttctatgctcaactcctgggatggggctgtgactggccaatcagagcatccctctgagccctgtgattggttcaggatggacacatgacccaaagaaagccaatgagacacagtcttgggactcttggtgggaacactgtaagagattcagagtctcacagagccaggaggaagtcagccttgagctgccaacagctactgccagcctgagactggagccaacccagtgggaaacagggctgagaggtggagaggaactgagtagtcctgacgacattgttaaagtgcatggatccacctgtgcctgaagccaatcctctgggctttttagtgacatgtctcaaagtaccttttcaccttagtcaattgaagttaggttttctgtcacttgacccctagctgaggctggagtatggagatgccaggtgtgtgaagataggaggcttagggagaccctaggtcggaggacacactgatggaccctggaagacaggagtccatgttggggagggctttgggggtccatgatgacgcagtcttaggggctatcttggagggtctgacgatctcaccaagcacaggtgtgctgtctagaaccttctgtgggagagtggtcgtctgcgagacaggctgctccgcttgccaaaggatactctcgagctctccgcggacagcagccagggcttcaggattcttgagaaggaagagcaggagccagaaggcagcgggacccatattcccctgcaaggagaagggcccctgttatgccattatgagggcagagctgactcgtctctgccagggacacagctcgggccaagacagaggggccagtaggcctgggttcccactgctgccaaacacccaggcatgaccagtgtctatctccagcctcaggacatggccaaaactgccctgtggcccaaaatacctacttcaaggccactcgtggcatccctgactgtgtgcaaagtcactaatcctaggtcacacaggtaatcttcatagctaatcagcaaaacagtgtcagtaataggaacagggtatatcagttaagactgttcacatctgagaatgatcacattgttggccccaattcttccccaatcgcagaatccacgctccttaccatgtgaatttgctgttcctcctattcaagagccagagcgtatttcccctgccctttgaatttatgctcagccgtggacttgctttggccaatagattgaggtggaattgaaggaacagccactctacgcctaagccgcgagagactttgtgtttccacttgctcggcaagcccactgatcccaagaggaggatgagagactcatggacagagctgagctgccccaatgagccagacccacagacccgtgagttaaataaatgctgatgggtgtatgccgctgatgagttgttatggatgtttgttatgcaacaatagctaactggtgtgatatctaaagatttgcttccaaatataatcattcttgatgtagtttgggaagcaaaaagttccctatatgctttgtatcttcaaattctatcagtcacttgaagaataaatgtgtgtgtgttgtgtacgtataaaacaaagccgcaatcatcattgatgactgaaagctatgaataaaaattatttaaacttcccaatagataaacacttaggaaaacgagtggaatttcttgcttcaaggcttcagtcttagctgaacattttcatacacattttagcctcagctctttggtatgtggctaaaatgtgtatatggcaccctttagtgatccagatatgggaagaataccaactaatctcaatttgggggaaggtttttgtctgccgtgactattctattcaatcataataatggaatattaaatcatcattaaatatcatgtttacccactaatttcattacagacataattacacatgggcaaaaggacatatgcacaaagataattattgcagtgctcatgtaatagaaaaatgctggaaacaatctcatgtctatcaataagagatcaatgagatcaatgaagatccatccattggatgatgtgatgcaggaagtcattaaaaagaagctggctctgtgtgtaccgatgtgggactgtagccaagacacacagaagcatgcaaacgcaaggtgcagggtggtggctcagcatgctgccatttgtgtgtttgtttaaagagaaatatacatgaagaagtacagaccatctctttttttttttgagacagggtcttgctctgtcacccagggtggaatgcagtggcacaatcatagctcactgcagcctcgacctcctaggctcaagtgatccttctgccttagcctcccaaggagctggggccacaggcatgtgctacccagctaggttttttttttttttttggtagagatggaggtctccctatgtttcccaggctgatctcaaactcctggcctcgagcagtcctcctgccacagcctcccaaagaagcacagaccatctctaagagacaccagaaacgggtaactgaggttaccttgggacagaagctgggaagacaagaggataaggaggaaggaggctgactttccttgcaaataccttttaaactgttcaaaattttttaatggacacactaattttaagtgaaacagaagccacccaggctggagtgcaatggcacgatcgtggctcactgcaacctccacctcctgggctcaagtgatcctcctacttcagcctcccaagtagctgatacaagcatgcaccaccatgcccggctaatctttctattttttgtaaagatgaggtctcactatgtttcccaggctgtatccaaatcatttctacagtgatgtacaatgtcatgagagatgctcatgttacaatattaaaccaaatagaaggttagattaaaacagctgcatgatcttaaccacagaagaaaaacctatggggaaaggctggaaagaaatgcaccatagcattagtgatggtgagatagattttgccttcctctttagtgcccgtgaggccaggaggaaccacactcctctgctcaatacttccatcacgcaggtgccattattaggccttttactgaaaaggaaaacgaagtactccccggtcactacccactgcccagcatatagtggaggctcactgatatttgtcaaataaacatctgcatccctttggattagaggtggagctccaagacagcctgggaggtgggctagaagatccctggactgagaccaggtagaggtgggttcaaatcccagctccccactttctgtgactgtggacaagtcacgtccccctttgggtctcaacactgggggtaacattgccacctcctgggtggacgcaagggtccagtgaggctgaatgcaagcaatcccacacgtgctgcgcccatagtaggtgctcagaagtggttactcctcccccactggcccctcccctggatttgaaaacaagtcgggggggcctccggccctttctgagagttccaccagcacctcaggtccagctgacacagcaaggtcacctgctgtccatcacttaaatagccaggcaaatgcggatgataaataattcaacaccagcttagctcagcgccaaggccattttatctggcccagatggttagatgggggccaccgctcattaattaccaagcaggagtggaacacatgggcgcttggctatctctgcctgcaggaaaaagctgtggcaagttagggaggtgaccaagaccgccttttacccaactgcacagatgtgagtgtgagtgtgtgtgtgtgtgtgtgtgtgtgcacacacaaccataagagatcctgaatttgccaccctggaatttgagctttcacccacggagccttgcctccgtttactcaggaagacacttcttgtttgtcttcattccctcctactgcagccaaaggccatgacccaaaagcagtgccacccctgttctagctttcctgtgaatggcagtggctgacctctgggaggcactgactgcgggccagaccacacccttggtgattcacatgctccttcttgttgcctcctgacaacatggcccatcagtggaagtgggggacttccgctgcccgctcctgcctgcatccgcttccttgtcgttggtaacagcaccccactttccttcaaagaaccacctcctcttaagtctaagtccatgtgggccatccaggactgacccatccttccagacttcaagtgtgggcatgggacccaggcggaggcactgagtgatccacgcagagtggggcatatgacgtgggctgggccagtgagtatcagtcttgggagctgtgctagaatttaggggaagggaagccctcctccatgggattgctaaattgcctagagctactggaggccattgtagtcatcccccagggggagaccctctgaggatgtagcctggcagaagaagggagacctgagggatgggggtcacagattgtgtttcttttaatttttatgatttagaagattccaacggaataaaagaatatcccgagtgtgatgatgtgttagtgtaggtcataaattgtaacaaatgtgccactctgctgagggacaccagcgatggagaggcgaggcattgggagaagggggctaagggagatccctgcacctttccttcaattttgttgtgaacctaaatctgctgtaaaaatagagtctatttaaaacaaacaaacaaaagccctaagtgcaatgtgggattgtggattggctcctggaagagaaaaagaatattagtagaaaaactggggcaatgtgaataaagtatagactttagttactagcaatgtcccaatgtgaatttcttagtcttgatgaatgtattgtggttatgtaacattagggaaagctgggtgaagggtatttgggaactcctgtactatctttgcaactcttttataatctaaaattatttcaagataaaactactgaagacaaaaaaaaaaacaaacaaaaaaaccaaccctctttacagatggtgaaacttaagcccagaaaagtgacttgtttgaggtcacataactagtttagtggcagaggtgagattccacccgagtctgtctgactctcaatactgtggttttgctttctactccgttgtcagatgcctcaaggattcttctcgatgatcactatctcagcggagctatgtgcaggcccagcagctcccgtggccccctcccctacctctcaggaccacccaggaatttccagggatgtgtggctgtggctgctgaggatgtgatggggtgaaggccaagccagatatcgggaaggaagagaaggatcagatgtgatggatggggctgagggacatcatgtcaatcaatggtttcagtcctggcattaccagcatcagtgggctcagagctggcagggaagcctgacctgtgtttggaaactctcctccgtctgccccccaccaccccaccccaccttcccttacagcctcctcttccccttgcctggaccttaggtctcggcccacagagtcctccctggatgcctgagactcccactgctccttccatcactctcgattccaggttcaggggttctggattcaggaagctgttgtgaggatcctatgagatggtggttgcaaagtgctcaacaggatgcttggcccagggtaagtgctcagtatcttttgagattattattcctgactcatcatctccgacctgacagcagcaatcacagctaccatttttcagcctctctgcagcatctgacccagcttcccactcccggctctcctcccaccttcctggcccctcctcctcacccttcccaccactggagagccccagggatgcccccttcttcacccaccctcgcctgcagtatctcctccagtcctgaggatttaaactcctctatgctgacaactcccaagcctggacctcaaacttgaactccagactctcttctccaggtgtccactcccccatctccatctcaaattcaacatacccaaagcccaacccccgatcttctccctgaaacttcctcctcccgccatctccctcttctgcccatggctctgccatccctcctgtcactcaggcccaaacctggattcatccttgatggcctcccccaaggtcccatccaacagcggatcctgttggctttactttgatatatgttcagaatctaaccacccctgaccctggcccagcagcaccctctcttgtctggatcctgctgctcctctctgctctccctgcctctgcttccccaccccctacagtctcttgtcagcgctgcagccagaatgatccctctaaagcgaaagacaggccaggttcttcctctgctcagagccctacagcaggcacctgtctcactcacagtaaaagccaaagccctccccatggcctacagggacctgtgtggtccggcagctctgcctccccaccgtgtcacccttagtcctgcctcagggcctttgcacttgctgctccctgcctgggaaacttcattctatatatttacatggttcacccctcacttccttcagtctctgctcagatgtcacctttcagtgaggccttcctgggcctgccttcctgctgcatctcttctccatagaacacattccctctaatacttttttttttttttgagatgggagtctcactctgttgcccaggctggagtgcagtggtgccatctcggctcactgcaacctccacctcccgggttcaagtgattctcatgtctcagcctcctgagtagctgggattacgggcctgtgcgaccatgcctggctaatttttgtatttttagtagagtcagggtttcatcatgttggccaggctggtctcaaactcctgatctcaagttatctgcctgccttggcctctcaaagtgctgggattacaggcgtgagccactgcgcctgacttctaatacattttagatgcttacttgtttgtttatttatttatttatttttgagacagggtctcactatgtcacccaagctggagtgcagtggcacaatcatggctcattgcagccttgacctcctaggctcaagcaatgctcttgcctcagcctcccaagtagctgggactacaggtgcgcaccatcacgcccagcttttctacaaaaaaaataaggtagtttttgcagagatggggtcttgctatgttgcccaggctggtcttgaactctaggactcaaatgatgttcctctctaacttcccaaagcactgtgatgacagcttatgtgtttattaattgtctatcttctcccaccagaatgccagctccctaagggcagggatttttgtctgttttgctcaccgctctatccccagcttctagaatggggcctggcccatggtaggtgctctaaatatttgttgaagatgtttcttgagcacttgttatctgcaaggcacagttacaaaattgcacatgtattcctgcctcctttcatcttcacaaccacgtcttgaaacgggtgctaccatctccattttacagatgagtaaaccgaggtgctcagaggttaagtgactgacttgccaggaagtgtcaaaatcaggattcaaactcaggctgggaggtcacagagcctgtgccagaaactcctaggccaagtaccctcttggctccactcccaaaaggcccttgaaaagttttcccacctgcctgaattctggacgctgtcaacgactcaacctcagaggacatcttgtccccagctcctgcccagctctcctggccctgccaaaggctgttccctggactttctgccactcaaacccctcagccagcatccagttttgctgacaccagtcattcccacgagagttctggagacactttggagctccaagtcatctctgcacataaatatgttattaggcactgatgtgggggacaactgccaattgatcccagtccccaccccttgccagtctctgcctgcaaggacagttaatggctctgaggaaactaaaaataagctgcaagtcgatgggagaggaattacccagaaatgtcagcttgtgcaactgtcaccgtcgaagtggggccaagagaaagatggggcttggggatcaggagagagggcaggaaccaggcctggagctgtgcagcatggaaggctaccatctttctctcactccaatatctggtccatgaccaagtccactgactctgtcttcctgaaatttccaaaatctatccacgtcctcatcacctccatggccaccacctgaccctgccaccacagtttcctccttgttgccctgtttttgcttttgcccccaagatcctgtccctcctctgctcagaactctcccaggcccccatctcgcccagagaaaaatcccaagtcctcatttatgaggacccacaaggccctcagtgacctcttccctcggtctcacgccccctccctcactctgcttcagctgtgtgatccaactctactctgcaagatccaaccccagggcctttgcacttgctgtttcccttatttggaatcttctatccccatatcttctccaagtctctgaatctagctttcttatcatccagggctcatctcaaatatctcagggaggcctccctgaccaccccagctagagcagacccgaaagtctctctattcacagccctgtttcatactctacatatcatcatctaaaatcaccttgtatatgtttccttgactctctgccccctgtcctcctgaccccccaaatggtaatcgacacaacacagaatctttgaggtctacggtaagtactcaaaggattttttttaagaggtggaatctcactatgttgcccaggctggtctcaaactcctgggctcaagcaatcctcttgcctcaccctcctgactagctgggactacaggtgcacactaccatgcccagtgtctcaatggaacttctaaacaattcttcaaaataactggtctgcacacttcaaaaaatgtaaatgtaatgagaaacaatgaaacgcacagaaaccgtgccagattaaagaaaatgggtcgggtgcagtggctcatgcctgtaatctcagcaccttgggaggctgaggctggtggatcacgaggttaaaagatcaaaaccatcctggccaacatggtgaactcccatctgtactaaaaatacaaaaaattagctggacgtggtggcatgcgcctgtagtcccagctattcaggaggctgaggcaggagaatcgcttgaactcagcaggcagaggttgccgtgagccgagattatgccactgcactccagcctggcgacagagcaagactccatctcaaaaaaataaaaaaattaaaagaaaagaaaacagaagagtcagaatgactaaatgcaacgtgtgattctggattggatgctggaccaagatgaaccaaaaaggacattattgagacaactggcaaaactggaatacagattgtttattagataatgatcatgtatttgggctcattatcctgaaattggttattgtactgtggtcatgcaggagatgttcttgcttacactcaagcaattagggataaaaaagcatgatatctgcaacttattcccaaattatttcaataaaataatcccagtggggaaaagagagcataagagagagagagacagagagagagaaagcaaaggtggtaaaatgtttaaaactggggaatcaaggtgaggcatatataggagttcattaaactatttattaaacttttctataaatttaacatttttccaaattaaaaaaaaacaaaaacaaaaaacaaaaaacaaaaagaagctgggcgtggtggctcacactgtaatcccagcacttccagaggccgaggcaggcagatcacttgaggtcaagtttgagaccagcctggccccatttctactaaaaatacaaaaattagccaggcatggtggcaggcaactgtggtcccagctactcgggaggctgaggcatgagaatcacttgaacctgggaggcggaggttgcagtgagctgagatcgagccactgcactccagcctgggcaacagagcgagactctgtctcaaaagaaaaaaaaagaaaagaataccgaatgaatgtttctgttcgtgatgctatttgacagtaaaggaagtcagggaactggtttgggcagtgggtatgtgtgcacacacccacactcacatcagcacacactcacaaatgcacacctacatacacatgcacacacaggcatagtcatgtgcacacctgcacaggtgcacagacatgcacacacacatgcgttcatatcgcaaccacacatgcacacctgcacacacccacttgcacattcacacccacctgtgtggcccacagctgcagcaccagggcccgtgcctgcatctcctctgacacacccatctcctccaggtgcagcaggtaactctccagccatttgctccggtgggcccgcctggccagcctggctggggatagcagcttccacaggcgacttttgacactgcacatgtggtccttgtcccctgcagggacagagcacagagagtaggggttacagattcaccatcccacacccagggctggccaggcatgacctcccatgaggccaagggtcttctgaatgtcactcattgagggtggggagttcctgtgggaaagaagctgcaggacaggcccacagcaggaagccctttcaataccaaattgcttattatctgtcttacccccagtaaaaagaagcaaggggtcttgtctcctgcaggtgggagcctgatctatttcaatcacctctatgtccccatcacccggcccgtagcaggtgctcaataaatatgcattgtattagtctgttttcatgctgctgacaaagacatacttgagactgggtaatttatttatttatttattttttaaaaaataggtttaatggactcacagttccatgtggctggggaggcctcataatcatagtggaaggtgaaaggcacatcttacatggcggcaagcaagagaaaatgaaagccaagcaaaaggagaaaccacttacaaaatcatcagatctcatgagacttattcactacaaggagaacagtatgggggaaaccacccccatgattcagttatctcccactgggtccctcccacaacacatgagaattatgggagctacagttcaagatgagatttgggtggggacacagcaaaactatatcatgcattaaataaatggtagttctttccagagcaggagaaggaacactaaacactgagcagcattctccctccccagggtccaaccccagagcaatgccagcccatgtgcatgaggaggaggccactgtgagcaggctcagcacagcagcaatcacagaaagacatcagcaacaacctaactggcagattgggctggagtctcaaactcaactcactccagagaaggcaggccaagtaaaagagagacgggccagaaaggggccatggcacttagcccaccaaccagccctcggcaggagagggaaacaccccagcatggccagaaggcctgtgctttcaaaggaagctgataatccagacaattatgtataaccttctgatgttttttaaggttagcatccaagtaaaaagtttttaatcactgtgcagaccacagaagcatctctgaaggtcaactttggcccacagatcactagcgtgcatcaccattaaacagacaatggtgtgtttatgttctggaaacatacagcagtgaaagtgagttagtacattttacctacagacacagagagttcccaagggcagactggtaaggggataaagccgggcactgaagaatgacactatttagatattgttttcttttctacttctttttttttttttaaaatattttcatgaaccatacatgagccttaatatacattgttttaaagctccacggtaatgctatttatatgcacaaatataaagtttaaaacaaaaatataaaatataaaatttggttttctccgaaatcaccccttggaaaagtgagagtcattttggattgctctgaagtttcaaagtattggaaactccctcactgactcttctgaaccacaagccgtgtttcaggaagactcgccccaccagcgattctaaacctggctgcacctcacagggcatttgaaagggtcgaaaatgtagactatgttttttttttaaagtatgttggcttcattttcaaataatacgctgaatatgtttaacttttagacttcaacttgagctcattgttttacattgaaatgaatgtcaccatttcgggtgacatttcaatgtaaagcaataagcttaagtgttcaactgaaatacattatcttcctatgtttctccacttttcaggctctctgaagaattacctgggagctcttaaatctctggatgcccaggtgccaaccccagattgatcatgtcaaaatcacgtgcgtgggaactgggcatccagaggtttaggcctgcagggcgcgggcagtgttgaaaccacctcagttgatgccaactctggatacttctaagcatcatctgatgggatggctaaaaaaagaggcaaagaaatttaacacagctttagaaataactggcattctttgaagtctgaccacacaactgcaatcttgaatatcactgtaaacacggcgtttacagatgactttaaaaagcaaggcaggaccattctccacttttcccctgtgcctacagcagttctgagtacataggaggcactctatatttgcacaatcaatgaataattaagcaaaaaaggtaatgcagtatgaaaagacagctgacagaaagtgagaaaatatttgtaaataatatatctgataagggtctaacacccaaaatatataaaagaactcctacgactcaacaacaataaaaaacaaacaacctgatttgaaaattggcaaaggacttgaatagatatttctccaaagaagagatacaaatggctgataaacacatgaaacaatgctcaacaccattagtcattagaaaatgcatgtaaaaaccacagtgtgataccattcacaaccatgaggatggctactatttaaaacataggaaataagtgatggtgaggacgtggagaaattggaacccttatgcattgctggtgggaatgtaaaatactgcagttgctgtgaaaaagagtttagcagttcctcagaaagttaaagaattaccatatgatccagtaattctagttctaggtatatagcccaaagaactgaaaccagagactcaaacagatactcgtgcaccaatgttcatagcagcattattcacagtagccaaaaggcagaaacaacccaaatgtcggttgataggtgaatggataaatagaatgcagtatatacacacaatgtattcactcttaaaaaggaatgaaattctgacgcatatgccaggcatggtggctcacgcctgcaatcctagcaccttgggaggccaaggtgggcagatttcctgggctcaggagttagagaaccagcatgggcaacatggtgaaaccctgtctctactaaaatacaaaaaaaaaaaaaaaaaattagccaggcatggtggtgtgtacctgtaatcccagctactcaggaggctgaggcacaagaatagcttgaacccgggaggcggagattgtagtgagctgagatggcgacactgcactccagcctgggcgacagagactctgtctccaaaatctcatataatgagaatcctagaacaggaaattcagagacagaaagtacaatagaagtatactattcgacagaaagtagaatagaaagtagaatagaagagacagaaagtagaatagaagatatgtcgggctgggaggaaaggcaggtggggaattattgtttaatgggcacaaagcttttgtttagaatcatgaaaagtttctggaaatagataacggcatggttatacaacattgtgaatgtatttactgccactgaattatacaattaaaatggttaaaatagtatattttatgttatttattattttaccacaatttttttaaaaggcatatgaaggtcatttggcaaaaatgagtcaaagatagtgttgtataacaaagaatttgcattctgggcgggtgcagtggctcacgcatgtaatcccaacactttgggaggccaaggtgggcagatcacttgagttcaggagtttgaagccagcctgaccaacatggtgaaaccccgtctctactaaaaatacaaaaaaggataagctgggggtggtggcaggcacctgtaatcccagttacttgggaggctgaggcagcagaatcacttgaacccgggaggtggaggttgcagtgagctgagatggagccactgcactccagcctgggtgacagagtgatactcaaaatacaaaagaatttgaattccaaggtttcagttacccatggtcaaccatggtccaaaaatattaaatgaaaaattccggacataaacagtcataagttttaaattacatgctgttctgagtagtgtgttgaaatcttgtgccatcctgctctgtcctgcctggcaaaaaacacaggataaaaatatagcagtgggctgggtgcagtggctcactcctgtaatcccagcacttggggaggccgagacgggcagatcacctgaggtcaggagttcgagaccagcctggccaacatggtgaaaccccatctctaacaaaaatataaaaatacaaaaattagccaagcatggtggtgggcgcctgtagtcccagctactcaggaggctggggcaggagaatcgcttgaacccaggaggcagaggttgcagtgagcggagattgcaccactgcactccaggctggacaacagagcaagcaagactctgtctcaaaaacaaaaaaaatatatatatagcagtgattggatcatggatcaaatcagtttacatttgtatatcccttagagcagtgtagaggacacactaaaccttacccaagagttatctattgctgtgatatattgttagcacaaagcaaagtgccagcaaccacgtgtttagtatgcatttgtggaaaaaaagaaaaataagaatatagtcacattcacttgcacttgtgtgaaggaactctagaaggatccatttgaaactaataaaactaatcaattatgagcagtgggaattggtggaaggggatgtgacaagaaaaggaaggagacttaccactgttattacttaatttttttccagccttgctgaggtataattgacaaaggaaaattcttatttaagttgtacaacatgatgttttgatacacaaatatggtgtgaaatgattgctgcaatcaagctaattagcatatccatcaccttacataggtgcacactcacacgtgcatgcatggtgagaatacttaagatccactctcttagcaaatttcaagtatacaatacattgtatacttgtatattaaatctccagaacttattcattttataactcaaagtttataccctcaaccaacacacccccatttccccacctcctgagccctggtaaccactgttctactgttcctctgaattcaacttttttagctcccacgtataaatgacataatgcggtatttgattttctgtgtctggcttatttcacttacaatattgtcttccaagttcatctatattgttacaaatggcaggatttctccctttttatggctgaataacattctttcgtggatttacatacacagcagtcctgtcttatccagtttcactttccaaggtttccatcacccatagtcaaccatggtccaagaatattaaatgaaaaactccctaagtttgaaatcgcacaccattctgagtagcatgatgaactcttgtgccatcctgctccatcttgcctggggggtgaatcatccctctgtccggtgtatccacactgtagaccacacctgcccattagtcacttgggagccactgtctcagttatcacgtcaactgtcatggtatggtagtacttgtgttcaggtaacccttattttgttttcattacagtatatcgttataattggtttcattttattatgttgttaatctcttactgtgcctcatttataaattaaactttatcaggccaggcatggtggctcacgcctgtaatcccagcactttggaaggccgacgtgggcggatcacctgaggtcgggagttcgagtccagtatgaccaacacagagaaaccctgtctctactaaaaatacaaaattagctgggtgtggtggtgcatgcctgtaatcccagctactcaggaggctgaggcaggagaatcgcttgaatctggggggcggaggttgtggtgagccaagattgcaccattgcattccagcctgggagacaaaaacgaaactctgtctcaaaaaaaaaaaaaaaaaattaaactctgtcatagttatgtatgtataagacaaaacagtatatacagggttcagtaccacccatggttcctgacatccactgggggtcttggaacatatcccctgaggttaagagggggccattgtaccactatctctgtatctgttcatgcactgatggacacttagtttgtttccatgtctcagctgttgtgaataatgctgcaatgaattggaggtgcagacatctcttcaagacagtgatttcatttcctttgaatatatacctagaagagggattgctggatcatgtggtagctctatttttgattttttaggaacctccatactgttctccatgatggctataccaatttaaattcccaccaccagtgcgaaagagttctcttttctccacatccttgccaatatttgtcatcttttgacatttctaacgggtgtgtggtgatatctccttgtgattttgatttgcatttccccaatgagtagtgatgttgaacaccttttcatacctgttgccatttgtatgtcttctttgggaaaaatgcctattctggtcctttgtccattttgcagtcaggttatttggatttttgtgttttttgaggcagagtctcgctctgtcgccaggctggagtgcagtggcgtgatctcggctcactgcaacttccacctcccgggttcaagcaattctcctgcctcagcctcccgagtagctgagactacaggcgtgcaccaccacgcccagctaatttttgtattttttagtagagacagggtctcaccatattggccaggatggtctcgatctcttgacctcgtgatctgcccaactcggcctcccaaagtgttgggattacaggtgtgagccaccgctcccagatgttatttggaatttttggtattgagttgtatgagttccttatctattttggatgttaaccccatatcgggtatgtggtttgtaatctactttacatttttaatgtttaaaccacgcgaaataatttttaaaataaaataatagaaaatctggcaaaccccccaaaaataatttccagtgaaacatcatatactgtagagattcaaggaattcagtgcatatgggagtgaggaagagaagattctggaaaactgagcttggtggctcaacctggggccctgcagatgagcaaagctgtgtagttaaagggggagtctgcataaagccccctcctgaaatgtggtcgtgggaagaaagcaaatgttcgaaatggttacagcacatttatacaattcactacagacgttcaacaaaacagatacggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcc
